United States Patent 7,745,391 (HUMAN THROMBOSPONDIN POLYPEPTIDE) - sequence listing, part 177

SEQ ID NO: 438853 - DNA, 6274 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaagtaggcaaaatagagacctgagattaaggcctatgagaggaacaaatgaattcaatgagttctccctaatttatgtctaaattgtaaataataccatagcagatagaatctgtgctaattttcaatgagtaatcatgggttcaatctcagtggctgccccttccctattgtaaaagaaaaatgtttggtggggtaggcggggatgagaggggtagatggtgatatgctgctgaataagaaggtttgattgataggtggaatgtgctatgatacatctccattgtttacattctaactccaggtaaatcatcctcagtttctctaagttcccctcctgactgttaactctctatagccttaggacatctgggatcaggaaattctccctgctctacttctttcttctgttacagatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacagatgcgccagggccgaggtaggctgggcgaggaagactctgatgtagatattgaagggtatgatgatgaggaggaggatgggaaacctaagactccagccccagaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagatggagtctccctctgttgcccaggctagagtgcagtggtgtgatctcggctcactgcaacctccacctcccgggttcaagcgattttcctgcttcagcctcctgagtaactgggattacaggcacgcatcaccacaccgggctgatttttgtaggctggagtgcagtggtacgatctcagctcactgcaacatccgcctcccgggttcaagcgattcttgtgcctcagcctcctcagtagctgggatt

SEQ ID NO: 438854 - DNA, 3416 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaagtaggcaaaatagagacctgagattaaggcctatgagaggaacaaatgaattcaatgagttctccctaatttatgtctaaattgtaaataataccatagcagatagaatctgtgctaattttcaatgagtaatcatgggttcaatctcagtggctgccccttccctattgtaaaagaaaaatgtttggtggggtaggcggggatgagaggggtagatggtgatatgctgctgaataagaaggtttgattgataggtggaatgtgctatgatacatctccattgtttacattctaactccaggtaaatcatcctcagtttctctaagttcccctcctgactgttaactctctatagccttaggacatctgggatcaggaaattctccctgctctacttctttcttctgttacagatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagtaaggctttatactagtttgtattagtcattaatacatctcatttatccttttaaaagagacagctttattgagataacataaaataaactgtacacatttaaagtatac

SEQ ID NO: 438855 - DNA, 1742 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaagtaggcaaaatagagacctgagattaaggcctatgagaggaacaaatgaattcaatgagttctccctaatttatgtctaaattgtaaataataccatagcagatagaatctgtgctaattttcaatgagtaatcatgggttcaatctcagtggctgccccttccctattgtaaaagaaaaatgtttggtggggtaggcggggatgagaggggtagatggtgatatgctgctgaataagaaggtttgattgataggtggaatgtgctatgatacatctccattgtttacattctaactccaggtaaatcatcctcagtttctctaagttcccctcctgactgttaactctctatagccttaggacatctgggatcaggaaattctccctgctctacttctttcttctgttacagatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttagaactgaaatgcactgatcttctggctgatgaaatgtggagatgatatcatcttatacg

SEQ ID NO: 438856 - DNA, 454 bp, Homo sapiens
gagcaatatgtctgtcttggatattcccagtgccactccagaaaagcaggtaacacaggtaggatgttctttttctctttataagattgttattgtgcctgcaagtggggctaggggaatggtgatggtgatggtgatatgtgacatatgtcaagaatgactgggccctttggccctgggaatgaaagcttagaaatgggatttcaagttgggatggcagcaggtcgtgtgactggtgttatattctctctgtccccatgggtagagtcaggcacagcagaacttcagggaagacacaagtatgaaaaaagggtgtgaagcatcagagtagcctgacgggtgactagagcgaccaactgcactcagacagttcaaaataattggcctactttatgtgtattataatttaaattaaaattatttataaaattaaattttaaaaattggccttttc

SEQ ID NO: 438857 - DNA, 337 bp, Homo sapiens
cagtgcctaaaatgaagtcaggaaaggacaaatcagcatattcttggggctgatgatgactttgatgctttttgtagaaccatagttttgtggcatgttgaactttgatagctccactcaatcccaagaaaatgatcatttgggagataaggggaacgtttggaaatcttttctacctaccttgcagcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacag

SEQ ID NO: 438858 - DNA, 398 bp, Homo sapiens
atagaacaaatgtttcccactgccctgagaatctttttctttatctcaggttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggtgagattgtgtttatttctagaatgaaaaagtcaagggagaaagaaatgggtgagtggaggacttggaatgtagttaaggtagcagaatgacttagatgcctacttaaaaggaattcaggtttttaggagtctcacttttttttgtttgaggtaggatgataaagaaccgcagccagtgaagaagacagtgacaggaa

SEQ ID NO: 438859 - DNA, 350 bp, Homo sapiens
tgctgggattacaggcgtgagccaccacgcccggcaaattgtccttaacttttctatggtgatcacaccttagggaaacctctgtcttggctttgctttgtttaatttcagaaagaagacaaattagctcgcttagagaaagctatcaaccccttgctggatgatgatgaccaagtggcgttttctttcattctggacaacattgtcacccagaaaatgatggcagttccagatgtaagctgtctctgtgccaaatactgtgaggatcgtgcaggggaaaggaaaaatgtttagggtgtacacgtgtgtgtattttggagagtctgagtggtggtgtatgtcagttgtga

SEQ ID NO: 438860 - DNA, 7637 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaaatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatgaggcttcctttgggcctccttggtcagccttccctgttctccagcctaggtggttcacctttccccaatttgttcatatttgtacagtatctgatcctgaaatcatgaaattaactaacaccttagcctttttaaaagtagtaagtaaatgataataaatcacctctcctaatcttcctggggcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgtaataaaaattttaaaaaattccaaaagtag

SEQ ID NO: 438861 - DNA, 6352 bp, Homo sapiens
agcctgcaacattattttaaagtgagaaatacactgtgtaggttccttttcagtggacacatgaataactccactaactcgctctactaacatgagtaactctttttatctttgccagaatcttgattgaaaggggcataaatgttttctctgttactatttcctccttgcactttgactaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatgaggcttcctttgggcctccttggtcagctatctgatcctgaaatcatgaaattaactaacaccttagcctttttaaaagtagtaagtaaatgataataaatcacctctcctaatcttcctggggcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgtaataaaaattttaaaaaattccaaaagtag

SEQ ID NO: 438862 - DNA, 8215 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaagtaggcaaaatagagacctgagattaaggcctatgagaggaacaaatgaattcaatgagttctccctaatttatgtctaaattgtaaataataccatagcagatagaatctgtgctaattttcaatgagtaatcatgggttcaatctcagtggctgccccttccctattgtaaaagaaaaatgtttggtggggtaggcggggatgagaggggtagatggtgatatgctgctgaataagaaggtttgattgataggtggaatgtgctatgatacatctccattgtttacattctaactccaggtaaatcatcctcagtttctctaagttcccctcctgactgttaactctctatagccttaggacatctgggatcaggaaattctccctgctctacttctttcttctgttacagatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacagatgcgccagggccgaggtaggctgggcgaggaagactctgatgtagatattgaagggtatgatgatgaggaggaggatgggaaacctaagactccagccccagaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatgaggcttcctttgggcctccttggtcagccttccctgttctccagcctaggtggttcacctttccccaatttgttcatatttgtacagtatctgatcctgaaatcatgaaattaactaacaccttagcctttttaaaagtagtaagtaaatgataataaatcacctctcctaatcttcctggggcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgtaataaaaattttaaaaaattccaaaagtag

SEQ ID NO: 438863 - DNA, 5032 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaagtaggcaaaatagagacctgagattaaggcctatgagaggaacaaatgaattcaatgagttctccctaatttatgtctaaattgtaaataataccatagcagatagaatctgtgctaattttcaatgagtaatcatgggttcaatctcagtggctgccccttccctattgtaaaagaaaaatgtttggtggggtaggcggggatgagaggggtagatggtgatatgctgctgaataagaaggtttgattgataggtggaatgtgctatgatacatctccattgtttacattctaactccaggtaaatcatcctcagtttctctaagttcccctcctgactgttaactctctatagccttaggacatctgggatcaggaaattctccctgctctacttctttcttctgttacagatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatggaataggcataaggatcaaacacacaaggtcgatagaaaaggggcacagtcatcaccaccttcctcgagaatagccttctttgactttcctgatctggataaatgtatttcccctctgaattcc

SEQ ID NO: 438864 - DNA, 2792 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaagtaggcaaaatagagacctgagattaaggcctatgagaggaacaaatgaattcaatgagttctccctaatttatgtctaaattgtaaataataccatagcagatagaatctgtgctaattttcaatgagtaatcatgggttcaatctcagtggctgccccttccctattgtaaaagaaaaatgtttggtggggtaggcggggatgagaggggtagatggtgatatgctgctgaataagaaggtttgattgataggtggaatgtgctatgatacatctccattgtttacattctaactccaggtaaatcatcctcagtttctctaagttcccctcctgactgttaactctctatagccttaggacatctgggatcaggaaattctccctgctctacttctttcttctgttacagatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggatactctggagaatacaaatctgtgaggaataatgagttgattaatgtcgactttcccaatccagattcacccactaccataagcgtgaattcaaaacctctcttcaccgattttctgtatacttgatttgggagattg

SEQ ID NO: 438865 - DNA, 447 bp, Homo sapiens
cagggtattcactgaccatcagccggttctttttccatctaggaataggcataaggatcaaacacacaaggtcgatagaaaaggggcacagtcatcaccaccttcctcgagaatagccttctttgactttcctgatctggataaatgtatttcccctctgaattcctacaacaattactgtctgtgcaactcattttcccagcttcctctaggtatcatccagtgtccaacacctctgctcaaagtgactgcttccagaacaacagtgcaacttaggcagttgctgaaccagagtaaaactcttagggacaggccgggcacggtggctcacgcctgtaatcccagcagtttgggaagctgaggagggcagatcacttgaagtcaggagttcaagaccagcctggccaacactccaacctgagtgacagagccagaccctgtctcaaa

SEQ ID NO: 438866 - DNA, 2489 bp, Homo sapiens
  misc_feature (64)..(64): n is a, c, g, or t
  misc_feature (67)..(67): n is a, c, g, or t
acgcgtggctcggcggactcggggtatcagctgtctggctccctacgtggctggggcacgtcancgncgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 438867 - DNA, 639 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtgggtacaggcatggctagcccaaacttagttggcctgatctgggcagggatcctagaggtcctcaggactcctggatcttaatccttttatgcagtcatggacccttttgagaatccaaggaaaactgagaaaaa

SEQ ID NO: 438868 - DNA, 2506 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 438869 - DNA, 2442 bp, Homo sapiens
ccccgcacacctgcagctaacgccccctcgcccacgcaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 438870 - DNA, 3367 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438871 - DNA, 2417 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 438872 - DNA, 3285 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438873 - DNA, 2367 bp, Homo sapiens
  misc_feature (22)..(24): n is a, c, g, or t
  misc_feature (44)..(44): n is a, c, g, or t
ctcctcttcccccacacccagnnntaggctaggtacgaggctgngtgtgtaatcggccgagggtcaccgccgaatggcagcctccagaaagccaccgcgagtaagggtgaatcaccaggattttcaactgagaaatttaagaataattgaacctaacgaggtgacacactcaggagacacaggtgtggaaacagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 438874 - DNA, 2339 bp, Homo sapiens
  misc_feature (22)..(24): n is a, c, g, or t
  misc_feature (44)..(44): n is a, c, g, or t
ctcctcttcccccacacccagnnntaggctaggtacgaggctgngtgtgtaatcggccgagggtcaccgccgaatggcagcctccagaaagccaccgcgagtaagacggcagaatgcctccaaaggtgacttcagagctgcttcggcagctgagacaagccatgaggaactctgagtatgtgaccgaaccgatccaggcctacatcatcccatcgggagatgctcatcaggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 438875 - DNA, 3271 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacagggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438876 - DNA, 1843 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccggtactatgaagatgggcttttggattcaccacccggcctcgtacctagccgtaa

SEQ ID NO: 438877 - DNA, 1700 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaagcaccttcttgactccttttgcccgttcagcttttattgggaattccaggggccctaaggatttaacttttggccacggggggaaacctggg

SEQ ID NO: 438878 - DNA, 3223 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438879 - DNA, 2776 bp, Homo sapiens
caagtcacttaagtctctgggccttagtttccccattggtaaactgagagtggtgaatgtaattacttgaggctgaagttaaaattaaatggattaagctgagaaaaatgcttaacaatacctagcatacaacacatactcaacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438880 - DNA, 2699 bp, Homo sapiens
  misc_feature (64)..(64): n is a, c, g, or t
  misc_feature (67)..(67): n is a, c, g, or t
acgcgtggctcggcggactcggggtatcagctgtctggctccctacgtggctggggcacgtcancgncgaatggcagcctccagaaagccaccgcgagtaagggtgaatcaccaggattttcaactgagaaatttaagaataattgaacctaacgaggtgacacactcaggagacacaggtgtggaaacagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438881 - DNA, 1931 bp, Homo sapiens
gtgtcctcctcccagattcactaagtgtttacatttgtggaataattaatttttaattaactttgttaggccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438882 - DNA, 2090 bp, Homo sapiens
gcctcagagcttttgccatcatgtctagtggatcagcccctgcccaggcaccaagtcctgccagcaggtccttcctttcactctcttttttgtctcctgctcttgtggcatgttgagttgagagtctgaaaactaagtttactcccagcgccattctgctgcaccacagtctttaaccaccgcaggttttgggttcatctaggcagctacactcaaaagacacccatgggcttggctgatcctagttttttattcagctttttcagtggatataggatatgtagcccagtgtgttggcaggacagcttcgagtgtctctctcagcaggagttctcacagagtccggggctattcccccacttaccacctcccaggatggctcaggtttaagggaatgaagccacacaggtgggagcaggagctactggcttagagactgctgtctataatagtaaactgttctgggagccttttcaccagaagccatgaagtctggtcctatgtatttccggggaaacagaacacaaggaaaatacttacctgtgagtaaggagaaagggtgttgcacaccttttctctcagcttgtgatcttagcacatgggggcctttgctgttgacctgtgtagccagttgttaaagatgtagtggtgaataccgtgtctgtccttctcttccctgcagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438883 - DNA, 1476 bp, Homo sapiens
aacgtatccctttaggtcactgtgcctggcatttcttgtacagtgtatatttgaaattatttactgtgagatttgtgtctaggactgacagcactgtgctcctcctgtagggaagtacctggtggcacagtccaggaacaagctacttgggagtccaggcacaggatgctgtgttgtcaatgaaaccaagcatcagggggaagaagcagagagatgcggccaagataggaccttgggccaaatccgctctcttcctgcccctctttatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438884 - DNA, 473 bp, Homo sapiens
atagatgtgttgtcgcctgatgggcctggctgggtcaaggcagaccacacagttgactgttataaaaatgattttgaggacttacacccctgcatcctggagaaccaaaaccagagatgcccctaagcccagatacccccatatcctgcccctgtttcctatcacagtagacattagccttgggacctgttgctgggagcccctcagcaccctttgtttggcctttcctgatggcacaggccattgtttgcccagtggaggagctcttggaaaatggcatcaggttccttgtgtgtctgtgaaaagtggtgaccagctcaccacttcttggctcccagttacccctggctctgagggatggcatgctggtggaatgacctcatggtgcttcagcatagtaaagaggagtaaaagcatctgttttcttctttctcccgcagtataattttaataaccggggaagcctgaccttt

SEQ ID NO: 438885 - DNA, 457 bp, Homo sapiens
agcttgggtctcaggactgttctttcagagcttgacacacagcttgttttcagtagtgtggtcttctcttgcccagaggtttctttggagtcaaggacccatctgccccactaggagctgatgcctcttactgctcttgcctgtctactgtcattttgtgcagcttctgagcagttgttagaaacctttcttcttcttttttttttctcccctgcttcaggcacagccatcatcacagaagagcatgcagccatgtggactgacgggcgctactttctccaggctgccaagcaaatggacagcaactggacacttatgaagatgggtgggtacaggcatggctagcccaaacttagttggcctgatctgggcagggatcctagaggtcctcaggactcctggatcttaatccttttatgcagtcatggacccttttgagaatccaaggaaaactgag

SEQ ID NO: 438886 - DNA, 594 bp, Homo sapiens
  misc_feature (64)..(64): n is a, c, g, or t
  misc_feature (67)..(67): n is a, c, g, or t
  misc_feature (500)..(501): n is a, c, g, or t
  misc_feature (504)..(504): n is a, c, g, or t
  misc_feature (508)..(509): n is a, c, g, or t
  misc_feature (518)..(518): n is a, c, g, or t
  misc_feature (521)..(522): n is a, c, g, or t
  misc_feature (529)..(529): n is a, c, g, or t
  misc_feature (539)..(539): n is a, c, g, or t
  misc_feature (542)..(542): n is a, c, g, or t
  misc_feature (544)..(544): n is a, c, g, or t
  misc_feature (547)..(547): n is a, c, g, or t
  misc_feature (563)..(563): n is a, c, g, or t
  misc_feature (586)..(586): n is a, c, g, or t
acgcgtggctcggcggactcggggtatcagctgtctggctccctacgtggctggggcacgtcancgncgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtcctgacagggacnncanccanncttcagganagnnctgggcntgggctgagntgntngcnttccctggaaaagggnatgccaaaggggctttggggtgntggggcac

SEQ ID NO: 438887 - DNA, 2492 bp, Homo sapiens
  misc_feature (22)..(24): n is a, c, g, or t
  misc_feature (44)..(44): n is a, c, g, or t
ctcctcttcccccacacccagnnntaggctaggtacgaggctgngtgtgtaatcggccgagggtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 438888 - DNA, 2419 bp, Homo sapiens
gtctgcaacttcctgttctttctctccttaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 438889 - DNA, 3316 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacgttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438890 - DNA, 3039 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcaagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438891 - DNA, 2442 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcaggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 438892 - DNA, 3109 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagacggcagaatgcctccaaaggtgacttcagagctgcttcggcagctgagacaagccatgaggaactctgagtatgtgaccgaaccgatccaggcctacatcatcccatcgggagatgctcatcaggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438893 - DNA, 2935 bp, Homo sapiens
cccaagttgagatgtgttaaaatcggcacggaggagcaaatggacagcaactgcacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438894 - DNA, 1769 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaagacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 438895 - DNA, 2646 bp, Homo sapiens
actgaatccttgcgcagcagctggactccaagctgaagctcttccctcccgctacaagcgaccccttaacatcttaagtcagacaggtgacagggattttgatttcttttctagggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgaaaaaaaaaaaaaaaaaaaaaaaaaaaaaaaaaaaaaaaaaaaaagggggggggggggaaaaaaaaaccccgaaggggggagcccaaaaaaagagcgagcacccgagattatgctgggaaaaaggggggcccaaaaggggagagggagaaaaaaaaagaaacgagcgaagggggcgagggagacaaaaagggggaggagggaggaaaaacaggggacaagggaggaaatcttggggaaagaggcaccaaaaccggggggggggagacaaagggggacaacacacacaacaggaaaatacaaccgcccaggggacaaacaacaaaattagcacacaggcgacacaagcgcggagaaacaaaaaaaggcaacaacgcaaccacccaaacaaaaaatagcgcaaacaagaaaaaacaaagagacaaaaaaaaacccagggcacagagagtataacaaacccacacagcacagacagacaccgcacaccgagccagacagacccgcgccaaccacgaacacacacgaggcgagacgacagagcaagagcacgcaccacggacaccacagaacagcagcacgcacgagcggaccgcaccggaccacgcagccaggcgagaaagagaacacaaagccacaaatcggaaacacacgacaccaggacaggggacacgcagaaacgagagcgagagccgggccacgggcgacaacaaaggggacacaacagcagtagacacgagcggagaagaacgcagcagcgcgcaaaccgcggacgagagagcagggagagcgaggagcgagcgcgcagcggggcacagacacgggatcacaggcgaggaggggagagagcgaacggggagagagcg

SEQ ID NO: 438896 - DNA, 1584 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacgttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaagggtaggtggtgcattctgtcacatgg

SEQ ID NO: 438897 - DNA, 926 bp, Homo sapiens
ctctcgcgactccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 438898 - DNA, 1170 bp, Homo sapiens
cgccgcagtcgagcggtcggtcgccacggtaacgcgcgcgggcaggtgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcggtgattgagaactgtgttgctgctgctggattcagtgtgggagagtttgcagccctagtgtttgccggagccatggaatttgctgaaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggttcccccaaactttcgaagtaggccctggcaggcagctgggagccatcctgaagagctgtaacatgcaggcctggaagtcctacagcgccgtggatgtgctgcagaccctcgaacatgtggacctggaccctcaggagcccccgagatgactgcagggggctcaaatgcgatgaccccctctgtcctcctgaggagaggctgtaggctgtgcctgtcgccccctaccttcctaatggctcctcctctgaggagtgaaagggatttgtttgcaacgtgctttgaaggccacataaaaagccctaaaaatga

SEQ ID NO: 438899 - DNA, 1388 bp, Homo sapiens
cgccgcagtcgagcggtcggtcgccacggtaacgcgcgcgggcaggtgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcggtgattgagaactgtgttgctgctgctggattcagtgtgggagagtttgcagccctagtgtttgccggagccatggaatttgctgaaggtttgtatgcagtgaaaatccgagctgaggccatgcaggaagcttcagaagctgtccccagtgggatgctgtctgtcctcggccagcctcagtccaagttcaacttcgcctgtttggaagcccgggaacactgcaagtctttaggcatagagaaccccgtatgtgaagtgtccaactacctctttccagattgcagggtgatttcaggacaccaagaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggttcccccaaactttcgaagtaggccctggcaggcagctgggagccatcctgaagagctgtaacatgcaggcctggaagtcctacagcgccgtggatgtgctgcagaccctcgaacatgtggacctggaccctcaggagcccccgagatgactgcagggggctcaaatgcgatgaccccctctgtcctcctgaggagaggctgtaggctgtgcctgtcgccccctaccttcctaatggctcctcctctgaggagtgaaagggatttgtttgcaacgtgctttgaaggccacataaaaagccctaaaaatga

SEQ ID NO: 438900 - DNA, 1742 bp, Homo sapiens
cgccgcagtcgagcggtcggtcgccacggtaacgcgcgcgggcaggtgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcggtgattgagaactgtgttgctgctgctggattcagtgtgggagagtttgcagccctagtgtttgccggagccatggaatttgctgaaggtttgtatgcagtgaaaatccgagctgaggccatgcaggaagcttcagaagctgtccccagtgggatgctgtctgtcctcggccagcctcagtccaagttcaacttcgcctgtttggaagcccgggaacactgcaagtctttaggcatagagaaccccgtatgtgaagtgtccaactacctctttccagattgcagggtgatttcaggacaccaagaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggttcccccaaactttcgaagtaggccctggcaggcagctgggagccatcctgaagagctgtaacatgcaggcctggaagtcctacagcgccgtggatgtgctgcagaccctcgaacatgtggacctggaccctcaggagcccccgagatgactgcagggggctcaaatgcgatgaccccctctgtcctcctgaggagaggctgtaggctgtgcctgtcgccccctaccttcctaatggctcctcctctgaggagtgaaagggatttgtttgcaacgtgctttgaaggccacataaaaagccctaaaaatgagtaaaaaattacatgacccagtccatttctcccccttggaaaaacgtttggacgttgggaagaatgatgccacagggctggtgtgtggggaagctagaatcctggccccgcctctgccagccctgcaccataggcaggtgtgccatctcagcgggaaggggaggactggctgctgcagcctgtcctgctctgtgagtgctgagaacatgctggtgtggcctcaatttcagccagtgccaggagaatcacttgaaccaggaggtggaggttgcagtgatccaagatcaagccactggactccaacctgggcaaccatcacaaaactcccatctcaaaataaaaatacaaacatta

SEQ ID NO: 438901 - DNA, 1422 bp, Homo sapiens
cgccgcagtcgagcggtcggtcgccacggtaacgcgcgcgggcaggtgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcggtgaggcccgaggccccgtgacaggagggggaaggtgattgagaactgtgttgctgctgctggattcagtgtgggagagtttgcagccctagtgtttgccggagccatggaatttgctgaaggtttgtatgcagtgaaaatccgagctgaggccatgcaggaagcttcagaagctgtccccagtgggatgctgtctgtcctcggccagcctcagtccaagttcaacttcgcctgtttggaagcccgggaacactgcaagtctttaggcatagagaaccccgtatgtgaagtgtccaactacctctttccagattgcagggtgatttcaggacaccaagaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggttcccccaaactttcgaagtaggccctggcaggcagctgggagccatcctgaagagctgtaacatgcaggcctggaagtcctacagcgccgtggatgtgctgcagaccctcgaacatgtggacctggaccctcaggagcccccgagatgactgcagggggctcaaatgcgatgaccccctctgtcctcctgaggagaggctgtaggctgtgcctgtcgccccctaccttcctaatggctcctcctctgaggagtgaaagggatttgtttgcaacgtgctttgaaggccacataaaaagccctaaaaatga

SEQ ID NO: 438902 - DNA, 1209 bp, Homo sapiens
cgccgcagtcgagcggtcggtcgccacggtaacgcgcgcgggcaggtgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcggttcacccacctcggcctcccaaagtgctaggattacaggtgattgagaactgtgttgctgctgctggattcagtgtgggagagtttgcagccctagtgtttgccggagccatggaatttgctgaaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggttcccccaaactttcgaagtaggccctggcaggcagctgggagccatcctgaagagctgtaacatgcaggcctggaagtcctacagcgccgtggatgtgctgcagaccctcgaacatgtggacctggaccctcaggagcccccgagatgactgcagggggctcaaatgcgatgaccccctctgtcctcctgaggagaggctgtaggctgtgcctgtcgccccctaccttcctaatggctcctcctctgaggagtgaaagggatttgtttgcaacgtgctttgaaggccacataaaaagccctaaaaatga

SEQ ID NO: 438903 - DNA, 2066 bp, Homo sapiens
cgccgcagtcgagcggtcggtcgccacggtaacgcgcgcgggcaggtgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcggtgattgagaactgtgttgctgctgctggattcagtgtgggagagtttgcagccctagtgtttgccggagccatggaatttgctgaaggtttgtatgcagtgaaaatccgagctgaggccatgcaggaagcttcagaagctgtccccagtgggatgctgtctgtcctcggccagcctcagtccaagttcaacttcgcctgtttggaagcccgggaacactgcaagtctttaggcatagagaaccccgtatgtgaagtgtccaactacctctttccagattgcagggtgatttcaggacaccaagaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggttcccccaaactttcgaagtaggccctggcaggcagctgggagccatcctgaagagctgtaacatgcaggcctggaagtcctacagcgccgtggatgtgctgcagaccctcgaacatgtggacctggaccctcaggagcccccgagatgactgcagggggctcaaatgcgatgaccccctctgtcctcctgaggagaggctgtaggctgtgcctgtcgccccctaccttcctaatggctcctcctctgaggagtgaaagggatttgtttgcaacgtgctttgaaggccacataaaaagccctaaaaatgagtaaaaaattacatgacccagtccatttctcccccttggaaaaacgtttggacgttgggaagaatgatgccacagggctggtgtgtggggaagctagaatcctggccccgcctctgccagccctgcaccataggcaggtgtgccatctcagcgggaaggggaggactggctgctgcagcctgtcctgctctgtgagtgctgagaacatgctggtgtggcctcaatttcagccagtgccaggggagcccctccaccacccccagcctgccccccagggctcctttgtcacaaatctgaaaggttttagaacccagttggccttggcagttttgttcacctcctcacttgacagctgggagacagaggcccacatttatggacatacccaagagatatgtattgcctgctgtgtgctagagagtgagtgcgctctgttctggtagaaaggtccttgagtgaggtgcggggtgtggggagtgccaggtagggagggcgactgaggccctggtcctaggggtggaaccatggaggaacaccctggtcacccactgggactgcgggtctgcggggcgccagagggagcacagcacatacctgcctcggagctgacccctggctccatgccccgtcctcagagcagctcctgcgccaatattaagtatgagacattccaagctg

SEQ ID NO: 438904 - DNA, 1848 bp, Homo sapiens
cgccgcagtcgagcggtcggtcgccacggtaacgcgcgcgggcaggtgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcggtgattgagaactgtgttgctgctgctggattcagtgtgggagagtttgcagccctagtgtttgccggagccatggaatttgctgaaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggttcccccaaactttcgaagtaggccctggcaggcagctgggagccatcctgaagagctgtaacatgcaggcctggaagtcctacagcgccgtggatgtgctgcagaccctcgaacatgtggacctggaccctcaggagcccccgagatgactgcagggggctcaaatgcgatgaccccctctgtcctcctgaggagaggctgtaggctgtgcctgtcgccccctaccttcctaatggctcctcctctgaggagtgaaagggatttgtttgcaacgtgctttgaaggccacataaaaagccctaaaaatgagtaaaaaattacatgacccagtccatttctcccccttggaaaaacgtttggacgttgggaagaatgatgccacagggctggtgtgtggggaagctagaatcctggccccgcctctgccagccctgcaccataggcaggtgtgccatctcagcgggaaggggaggactggctgctgcagcctgtcctgctctgtgagtgctgagaacatgctggtgtggcctcaatttcagccagtgccaggggagcccctccaccacccccagcctgccccccagggctcctttgtcacaaatctgaaaggttttagaacccagttggccttggcagttttgttcacctcctcacttgacagctgggagacagaggcccacatttatggacatacccaagagatatgtattgcctgctgtgtgctagagagtgagtgcgctctgttctggtagaaaggtccttgagtgaggtgcggggtgtggggagtgccaggtagggagggcgactgaggccctggtcctaggggtggaaccatggaggaacaccctggtcacccactgggactgcgggtctgcggggcgccagagggagcacagcacatacctgcctcggagctgacccctggctccatgccccgtcctcagagcagctcctgcgccaatattaagtatgagacattccaagctg

SEQ ID NO: 438905 - DNA, 1204 bp, Homo sapiens
cgccgcagtcgagcggtcggtcgccacggtaacgcgcgcgggcaggtgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcggtgaggcccgaggccccgtgacaggagggggaaggtgattgagaactgtgttgctgctgctggattcagtgtgggagagtttgcagccctagtgtttgccggagccatggaatttgctgaaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggttcccccaaactttcgaagtaggccctggcaggcagctgggagccatcctgaagagctgtaacatgcaggcctggaagtcctacagcgccgtggatgtgctgcagaccctcgaacatgtggacctggaccctcaggagcccccgagatgactgcagggggctcaaatgcgatgaccccctctgtcctcctgaggagaggctgtaggctgtgcctgtcgccccctaccttcctaatggctcctcctctgaggagtgaaagggatttgtttgcaacgtgctttgaaggccacataaaaagccctaaaaatga

SEQ ID NO: 438906 - DNA, 4855 bp, Homo sapiens
cgccactccgggtttatttgtttacaagcggattacgtcagctcctccctctcttccctatctctggacccgcctcctgaactcttttcccgcccctttcggctccgaaccggcttgcgtcacaatggtgcgatattcggattggctggagtcggccatcacgctccagctacgccacttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggttgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttc

SEQ ID NO: 438907 - DNA, 4629 bp, Homo sapiens
ggttgcttgaggcttgtggagatctacgatatgctgcgagctcgtaggatcgcgccggtagcatgtccaaggtcgcgagccatgatcagccgagtgccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggttgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttc

SEQ ID NO: 438908 - DNA, 4812 bp, Homo sapiens
cgccactccgggtttatttgtttacaagcggattacgtcagctcctccctctcttccctatctctggacccgcctcctgaactcttttcccgcccctttcggctccgaaccggcttgcgtcacaatggtgcgatattcggattggctggagtcggccatcacgctccagctacgccacttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggttgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttc

SEQ ID NO: 438909 - DNA, 4802 bp, Homo sapiens
cgccactccgggtttatttgtttacaagcggattacgtcagctcctccctctcttccctatctctggacccgcctcctgaactcttttcccgcccctttcggctccgaaccggcttgcgtcacaatggtgcgatattcggattggctggagtcggccatcacgctccagctacgccacttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggttgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattggttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttc

SEQ ID NO: 438910 - DNA, 4801 bp, Homo sapiens
cgccactccgggtttatttgtttacaagcggattacgtcagctcctccctctcttccctatctctggacccgcctcctgaactcttttcccgcccctttcggctccgaaccggcttgcgtcacaatggtgcgatattcggattggctggagtcggccatcacgctccagctacgccacttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggttgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttactagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttc

SEQ ID NO: 438911 - DNA, 5056 bp, Homo sapiens
cgccactccgggtttatttgtttacaagcggattacgtcagctcctccctctcttccctatctctggacccgcctcctgaactcttttcccgcccctttcggctccgaaccggcttgcgtcacaatggtgcgatattcggattggctggagtcggccatcacgctccagctacgccacttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggttgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgactggccgaggctgcgcgcctgattcctgttttggcggctcaaccggttggttcctggagattgttttgtccggtactactgtgttatttctaaaaccctgcccgctttttccatccccgcacatgcacaacaacggatgcaatcctggacattttaaaaagttgatagttttcattttcgctcctcaaaggagcctggggtaggaggaatccgcagtgggagctaacgatcctaagcgttgtttctctgttcttcttttcttctatagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttc

SEQ ID NO: 438912 - DNA, 4801 bp, Homo sapiens
cgccactccgggtttatttgtttacaagcggattacgtcagctcctccctctcttccctatctctggacccgcctcctgaactcttttcccgcccctttcggctccgaaccggcttgcgtcacaatggtgcgatattcggattggctggagtcggccatcacgctccagctacgccacttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggttgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcagttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttc

SEQ ID NO: 438913 - DNA, 3928 bp, Homo sapiens
gctgatgatgatccatccacagactatatcttaacctgatacagtcatcatattgtagtttttggaagggctcgttctgcccaagagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttc

SEQ ID NO: 438914 - DNA, 3692 bp, Homo sapiens
ggacgcgtgggtcgacccacgcgtcgaataaagtgatcatttacttgctagggagggaagtgatcatttaatagcctgtgagtccaagtaaatgatcacttccctccctagcaaataaagtgatcatttacttgggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttc

SEQ ID NO: 438915 - DNA, 2006 bp, Homo sapiens
cgccactccgggtttatttgtttacaagcggattacgtcagctcctccctctcttccctatctctggacccgcctcctgaactcttttcccgcccctttcggctccgaaccggcttgcgtcacaatggtgcgatattcggattggctggagtcggccatcacgctccagctacgccacttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggttgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcatt

SEQ ID NO: 438916 - DNA, 4800 bp, Homo sapiens
cgccactccgggtttatttgtttacaagcggattacgtcagctcctccctctcttccctatctctggacccgcctcctgaactcttttcccgcccctttcggctccgaaccggcttgcgtcacaatggtgcgatattcggattggctggagtcggccatcacgctccagctacgccacttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggttgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaacactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttc

SEQ ID NO: 438917 - DNA, 2587 bp, Homo sapiens
cgccactccgggtttatttgtttacaagcggattacgtcagctcctccctctcttccctatctctggacccgcctcctgaactcttttcccgcccctttcggctccgaaccggcttgcgtcacaatggtgcgatattcggattggctggagtcggccatcacgctccagctacgccacttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggttgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattaaaaaaaaaacaaaaaaaaacaaaaaaaaaaaaagacaaaacaaaacaaaaaaaaaaaaaaaaaaaaacacacaaaaaacaaaaagaggggggggcgccgcgcaaaaaaacaccccggggggacccccacaccgccgcgcacccccacattttgtttcaaaaaagggggccccccaaaaggggggagctttaaaactaaagacaccggagggcggcgccggacatacaaacacgacgaagcccggagcgggaataacaaccagccgcgagcgaggcaatctatgaaggagaagagacacaccaccacactcgaggggcggggggcgaagcaccatcacggggaggcgcacacacaccacccacgcaagaggaaaatattacagcgaccgcagcgggaaggaatcaacataaacaaccatgacgggagtgtcgacagatcggtggagcacaaccacaccgcacaatatcatcgcgtcgcagatagaacacaaagataggcacccacccgacatcattcaatcaaagcaaacaatactttaccaacacagagcaggctccgttatataagtaaaaccaaaaga

SEQ ID NO: 438918 - DNA, 2158 bp, Homo sapiens
cgccactccgggtttatttgtttacaagcggattacgtcagctcctccctctcttccctatctctggacccgcctcctgaactcttttcccgcccctttcggctccgaaccggcttgcgtcacaatggtgcgatattcggattggctggagtcggccatcacgctccagctacgccacttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggttgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatctgtacaacttttccacaaaccaccaatcgtattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcatt

SEQ ID NO: 438919 - DNA, 4235 bp, Homo sapiens
ccgaggcgggagctgcggtccgaggaccgtcggcggatttggggacaaaggagccgtggggctgggaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttc

SEQ ID NO: 438920 - DNA, 1157 bp, Homo sapiens
cgccactccgggtttatttgtttacaagcggattacgtcagctcctccctctcttccctatctctggacccgcctcctgaactcttttcccgcccctttcggctccgaaccggcttgcgtcacaatggtgcgatattcggattggctggagtcggccatcacgctccagctacgccacttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggttgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagacctctgactatgtgaagatacggtgggaagatgactgaccgcaagacaggaagagagccctcaccgaggaaccaaatgggcagtatcttgatttggatttctcaactcaagaaccatgagaaatgaatgtctgctgttcaagccacccagtcaatggtatttggttatgggcagcccagttgacaagagagcgcatatgaatttaatgagcatttgagaaaaggtaatgtttttcatttttttcccttagaagcatctatcgatcttcattgacattctgtggtcagaacttggaattatagacgtaagagaatggggtaggtgcatggaagaattagggcaacggtatgacagggaaggagaggtgggagagggattagtggcctttaaatttataaatagggtataacaaagggtagaagaggggagtaaggcataaaaaaggatactagaaattggaaggagaaaga

SEQ ID NO: 438921 - DNA, 4667 bp, Homo sapiens
  misc_feature (1534)..(1534): n is a, c, g, or t
gggcagggaaggccaaaggtccaagggagccggcccagggagccctggccctgacctcccagaggctctagctctgtgggtgaaggctgctgtggcaccagccgggggcaggtctgcacagtggacagactctggtggaagcatcctggatcccagggccaggtcaggcccccagacaggggtgtagacatgctttataagtggggaagggcctgcttcctgagtcggaggctgagaggatggagggtgcagctttagtactgggcacctcagtgacttatatcacacccatgccctgcagcctaccccgtgcggtgcctgctgcccagtgcccatggctcttgcgcagactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggtgaggcccaccttccccaggtgagggggttaggacgcccagacaaggagcatgccagttggagctaaacccctgaagtcagccggccctccctccccatccctaacttctgtttctcccgagagccctgcctggtgggccttgttgccatcattctacagatggagaagctggggcttcagagacttgaggctactctgatgtctaatagacatctgtgcagatggtggctccggggttctccatcagatctcgccagtataccccggggcctgtctggctggaaaagtttattggcttcgtgacctttggcaagtcacccaacttctccaagcctcagtttcttgacctgtaaaatggtggcattaccttctgccctgtatacctcacaggtgtgggttctggtcaagatgactcctgggactggatcatattaatgaaggatttgggaaggttaaaaacaaaattaaaagcgttgtgttccacatgggtcgagcgtgtagtttagcccccacatgaacctggtgtgtgccgtccctcccgacctctccccaccccttgggctttgcacctaccttgttgctgctacaagaacaggttgaggcagtgatgcttgggggagccgggggcaggttggggagggtagattcctgaatccatgggcttctggggctctgcctcccatagggaccctctagccccaaaagtgcctgtgacaggatgggccccaagctgtctgtcatggaacacactgnttagggtggttctggtcctggcgctcatgccagtcagcagatctcacttcccacctctccaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaacgggctacctgtgcaggctgatggccaccgtgtccaccagtccccagatggcacgctgctcatttacaacttgcgggccagggatgagggctcctacacgtgcagtgcctaccaggggagccaggcagtcagccgcagcaccgaggtgaaggtggtctcaccagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctggcaaagggagttatcttctggaatacattagctctttcaaaaacccacccagtgtttagcctcaacggcagccagttaccagcttctctctgtagccttcagcagtgtttgcatctctgacataaccacaggctgctgttttcaagaagagcaatctgtttggataagaaaaacctttactttacagcttccctttataatttgttacacaggaatagttaaatgcatttgtttgtttgttttttgagacagagtttcactcttgttgcccaggctggagggcaatggcgcgatctcagctcactgcaacctccgtctcctgggttcttgattctcctgtgtcagccttctgagtagctaggattacagatgcctatcaccatgcctgggtaatttttgtatttttagttgagatggggtttcaccatgttggccaggctggtctcgaacttctgacctcagatgatctgcccgcctcagcctcccaaagtgctgggattacaggcatgagccaccacgcccagccatcaatgcattttttttattttttttttgagacagagtttcgcacttcttgcccaggctggagtacaatggtgcgatcttggctcactgcaacctccacctcctgggttcaagcgcttctccagcctcagcctcctgagtagctgggattacaggtatgtgccaccatgcctggctaattttgtatttttagtagagacggggtttctccatgttggtcagactggtcttgaactcccgacctcaggtaatccgcccgcctcggcctcccaaaatgctgggattagaggtgtgagccactgtgcccagcccatcaatgtgttttaaagctagctgtcagggttccacttaatttaaagctgggcagggagatgtgtaatgatttcaaagttaacacctgtttgttttctaaagggcatgccaagtcctgctgtatcagggaagtattctgtgctaaaatcagcgatggttcattgctctagtctctctcacccttctaggcagtgcatcagtcagctctaaatctggtgcagagggttaacagcataacccttgttggcaaaatggaatagatgttaagacctcaaatagggatttgggatgaaacagctgcagttagcactgttatctgagcatgaaagaactggaaacgctccttacgtcgagatgttggaccttgaagccctcctgaggccaacatgcaaatctggctgtgacggttcatctgacacctgtgtaaagctgaccagcctgctctgtacagtgacaatgaggagcccctctcttccttaagtaggaatctgtgaagcaaaatgtttgctgccaaagacaaatcagactgtcagtcattaaaaacagcattagcaggatgaggatagcaatggggaagggttgtgggcaatgcagtaacagggaaatggcttcagaaatggtttgagttggaagacaacattcttcatctctcaggacttctaattccttgatgctaaaagaagaggcatggattctatgagcttccaagtccctttccactttaaccttctacaaatctttcagaggactgcctagtagcaaaggttattcctggacacaggaaagacgggcattacagggaccaaagctctgaaaggtgacttttattaccaacacactggctggaaaagggacaaaccacatcacgggtgagtgatacttctcagtcttctctactcattcaacaaaggaaatgtgggctggggcagaggtcttttttcatttaatactggaaaaatattgaagagcatccatgttcacttatggctggttttgctatagaaattggaaaataaaggccacttttttga

SEQ ID NO: 438922 - DNA, 2918 bp, Homo sapiens
cagtgtagttagtattagagccaccgttaacaggactgttttcctattaccttgtctaatatgcattgcttcctctggggaaagtgaaaaactggaaggatgaggacccaggtgactaagataagctggtgatattgaagggacaaaactttgatggttggaggaacccagcagagaaagggaaaagataagagctcttgctaactcaaaattttacttggggctgatcctacctgctctcccaatccagaggcaagaacagttgtcatttagtaattcaggtctcaaacatttttttttaacttcaagagatgtttaattatccagtcaataaatatttgggagtctaggaagagctattcagtgggctgaggccacaaataataatgggaggaccactgcatgttgaagtgaggccaagaaacaggtagaaatcatcatccctcatagagtttgtacgtatggttaaaaggttacagggtaagtgcacttcgttttcaatctggcagttataatgctgtgttcctttgaaggaaatgaaatggcaggtgagaattttcagcatacacagagcttcctcaccaccttctctctcccctgtcgttctgcagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctggcaaagggagttatcttctggaatacattagctctttcaaaaacccacccagtgtttagcctcaacggcagccagttaccagcttctctctgtagccttcagcagtgtttgcatctctgacataaccacaggctgctgttttcaagaagagcaatctgtttggataagaaaaacctttactttacagcttccctttataatttgttacacaggaatagttaaatgcatttgtttgtttgttttttgagacagagtttcactcttgttgcccaggctggagggcaatggcgcgatctcagctcactgcaacctccgtctcctgggttcttgattctcctgtgtcagccttctgagtagctaggattacagatgcctatcaccatgcctgggtaatttttgtatttttagttgagatggggtttcaccatgttggccaggctggtctcgaacttctgacctcagatgatctgcccgcctcagcctcccaaagtgctgggattacaggcatgagccaccacgcccagccatcaatgcattttttttattttttttttgagacagagtttcgcacttcttgcccaggctggagtacaatggtgcgatcttggctcactgcaacctccacctcctgggttcaagcgcttctccagcctcagcctcctgagtagctgggattacaggtatgtgccaccatgcctggctaattttgtatttttagtagagacggggtttctccatgttggtcagactggtcttgaactcccgacctcaggtaatccgcccgcctcggcctcccaaaatgctgggattagaggtgtgagccactgtgcccagcccatcaatgtgttttaaagctagctgtcagggttccacttaatttaaagctgggcagggagatgtgtaatgatttcaaagttaacacctgtttgttttctaaagggcatgccaagtcctgctgtatcagggaagtattctgtgctaaaatcagcgatggttcattgctctagtctctctcacccttctaggcagtgcatcagtcagctctaaatctggtgcagagggttaacagcataacccttgttggcaaaatggaatagatgttaagacctcaaatagggatttgggatgaaacagctgcagttagcactgttatctgagcatgaaagaactggaaacgctccttacgtcgagatgttggaccttgaagccctcctgaggccaacatgcaaatctggctgtgacggttcatctgacacctgtgtaaagctgaccagcctgctctgtacagtgacaatgaggagcccctctcttccttaagtaggaatctgtgaagcaaaatgtttgctgccaaagacaaatcagactgtcagtcattaaaaacagcattagcaggatgaggatagcaatggggaagggttgtgggcaatgcagtaacagggaaatggcttcagaaatggtttgagttggaagacaacattcttcatctctcaggacttctaattccttgatgctaaaagaagaggcatggattctatgagcttccaagtccctttccactttaaccttctacaaatctttcagaggactgcctagtagcaaaggttattcctggacacaggaaagacgggcattacagggaccaaagctctgaaaggtgacttttattaccaacacactggctggaaaagggacaaaccacatcacgggtgagtgatacttctcagtcttctctactcattcaacaaaggaaatgtgggctggggcagaggtcttttttcatttaatactggaaaaatattgaagagcatccatgttcacttatggctggttttgctatagaaattggaaaataaaggccacttttttgaaatccccagtttaattaaaccagattttggcctattggtataaacacatcagaaggtaagtttgaggttagctagcagctaactagttctaatagaaccagtcacagaatagtgggctaagattagaggtaaaactcattctaggccagtggttctcaactttaccatattgcgagctta

SEQ ID NO: 438923 - DNA, 859 bp, Homo sapiens
cctcctagccctcttacccattgctatcgccaacatgcaaatctggctgtgacggttcatctgacacctgtgtaaagctgaccagcctgctctgtacagtgacaatgaggagcccctctcttccttaagtaggaatctgtgaagcaaaatgtttgctgccaaagacaaatcagactgtcagtcattaaaaacagcattagcaggatgaggatagcaatggggaagggttgtgggcaatgcagtaacagggaaatggcttcagaaatggtttgagttggaagacaacattcttcatctctcaggacttctaattccttgatgctaaaagaagaggcatggattctatgagcttccaagtccctttccactttaaccttctacaaatctttcagaggactgcctagtagcaaaggttattcctggacacaggaaagacgggcattacagggaccaaagctctgaaaggtgacttttattaccaacacactggctggaaaagggacaaaccacatcacgggtgagtgatacttctcagtcttctctactcattcaacaaaggaaatgtgggctggggcagaggtcttttttcatttaatactggaaaaatattgaagagcatccatgttcacttatggctggttttgctatagaaattggaaaataaaggccacttttttgaaatccccagtttaattaaaccagattttggcctattggtataaacacatcagaaggtaagtttgaggttagctagcagctaactagttctaatagaaccagtcacagaatagtgggctaagattagaggtaaaactcattctaggccagtggttctcaactttaccatattgcgagctta

SEQ ID NO: 438924 - DNA, 2656 bp, Homo sapiens
cagtgtagttagtattagagccaccgttaacaggactgttttcctattaccttgtctaatatgcattgcttcctctggggaaagtgaaaaactggaaggatgaggacccaggtgactaagataagctggtgatattgaagggacaaaactttgatggttggaggaacccagcagagaaagggaaaagataagagctcttgctaactcaaaattttacttggggctgatcctacctgctctcccaatccagaggcaagaacagttgtcatttagtaattcaggtctcaaacatttttttttaacttcaagagatgtttaattatccagtcaataaatatttgggagtctaggaagagctattcagtgggctgaggccacaaataataatgggaggaccactgcatgttgaagtgaggccaagaaacaggtagaaatcatcatccctcatagagtttgtacgtatggttaaaaggttacagggtaagtgcacttcgttttcaatctggcagttataatgctgtgttcctttgaaggaaatgaaatggcaggtgagaattttcagcatacacagagcttcctcaccaccttctctctcccctgtcgttctgcagcacccaccgcccagcccagggaccctggcagggactgcgtcgaccagccagagctggccaactgtgatttgatcctgcaggcccagctttgtggcaatgagtattactccagcttctgctgtgccagctgttcacgtttccagcctcacgctcagcccatctggcagtagggatgaaggctagttccagccccagtccaaaatagttcatagggctagggagaaaggaagatggactcttggcttcctctctctggctggcaaagggagttatcttctggaatacattagctctttcaaaaacccacccagtgtttagcctcaacggcagccagttaccagcttctctctgtagccttcagcagtgtttgcatctctgacataaccacaggctgctgttttcaagaagagcaatctgtttggataagaaaaacctttactttacagcttccctttataatttgttacacaggaatagttaaatgcatttgtttgtttgttttttgagacagagtttcactcttgttgcccaggctggagggcaatggcgcgatctcagctcactgcaacctccgtctcctgggttcttgattctcctgtgtcagccttctgagtagctaggattacagatgcctatcaccatgcctgggtaatttttgtatttttagttgagatggggtttcaccatgttggccaggctggtctcgaacttctgacctcagatgatctgcccgcctcagcctcccaaagtgctgggattacaggcatgagccaccacgcccagccatcaatgcattttttttattttttttttgagacagagtttcgcacttcttgcccaggctggagtacaatggtgcgatcttggctcactgcaacctccacctcctgggttcaagcgcttctccagcctcagcctcctgagtagctgggattacaggtatgtgccaccatgcctggctaattttgtatttttagtagagacggggtttctccatgttggtcagactggtcttgaactcccgacctcaggtaatccgcccgcctcggcctcccaaaatgctgggattagaggtgtgagccactgtgcccagcccatcaatgtgttttaaagctagctgtcagggttccacttaatttaaagctgggcagggagatgtgtaatgatttcaaagttaacacctgtttgttttctaaagggcatgccaagtcctgctgtatcagggaagtattctgtgctaaaatcagcgatggttcattgctctagtctctctcacccttctaggcagtgcatcagtcagctctaaatctggtgcagagggttaacagcataacccttgttggcaaaatggaatagatgttaagacctcaaatagggatttgggatgaaacagctgcagttagcactgttatctgagcatgaaagaactggaaacgctccttacgtcgagatgttggaccttgaagccctcctgaggccaacatgcaaatctggctgtgacggttcatctgacacctgtgtaaagctgaccagcctgctctgtacagtgacaatgaggagcccctctcttccttaagtaggaatctgtgaagcaaaatgtttgctgccaaagacaaatcagactgtcagtcattaaaaacagcattagcaggatgaggatagcaatggggaagggttgtgggcaatgcagtaacagggaaatggcttcagaaatggtttgagttggaagactcatgatgagtactaagctgagtttatttcaggaatgtaaagttggttgactattcaaaaaatctaatcagtggaataaaccaattaacaattaagataaaaatcataatcatctcggctaggcatggtggcatgcgcctgtagtcccagctctttgggaggctgaggcgggcggatcgcatgaggccgggagttcaagaccagcctggccaacatggtgaaaccctatctctacaaaatataccaaaattagccgggcgtggtggtgcctgcctgtctcaaaaaaagcaagactctgtctttaaaaaaaaaaa

SEQ ID NO: 438925 - DNA, 1474 bp, Homo sapiens
gccgccgcccgcgacctcctctcctcctccgtcgtcaccccggccgccctgccagccccgaacttgcccgcgcctggccgcgcggcccctcagcccacggggctggcggcgcggttgggatgggaccgatgtggcgcatgcgtggtggcgccactaggcgcgggagttgctgcggcggggacggtgctgcggacggccgagggccaggccgctccggccgggctcgtggtgggggcagccccagcggcggcggcggcggcgtgggctggcgaggccgcgcggacggcgcccgacagcagctggaggagcggtttgccgacctggcggcgagccacttggaggccatccgtgcgcgggacgagtgggaccggcagaacgcgcggctgcgtcaggagaacgcccggctgcggctcgagaaccggcggctgaagcgcgagaaccgcagcctcttccgtcaggctttgcggctccccggcgaaggcggcaacgggacgcccgcggaggcacgccgggtccctgaagaggccagcacgaaccggagggctagagacagcggccgagaggacgagccgggcagccccagggccctgagggcccgacttgagaagctggaagccatgtaccgccgggccctgctgcagctgcacctcgagcagcggggaccacgtccgagcggggacaaggaggagcagcctctacagtgaacccgactccggcctccgctcccgggactcggagccctctgggccctggctgtagccgaggccgcagccggtgagaggcggagcctcggagcgggcccctcctcctccgttcccagctacccccgacctcgcgcacgccctggcccgcgccctgcccgcggataccttggactacggtgccttcccgcccccaccagtggacacttccgggtggcgcttggccatccgcttggtggaggtcgagtgggtgcaagggccctcaggacctcccacatgtacagttcccctgcctcttgccccggctagtttccctggagagaggcctagccaacaacgaagggacggattttaaaacagcgagaactgggtgccaagaaacacttcatattccctgaacttttctggatgttgtgcgaacctgttgtatttttttttttcctgtattttggttctgagggatgagtaatgtgtttttagttggttgagtttatccattcttcaatcccctaaagccttcagctattctttcatatgtggccaacattttaagtacagtgtttgcttttataagtcggtgttacttggatgtcctataaaatacccactttttataaagatgatatttataacctaggaactcatgcctgtcttggctgcagtccctgtacatctaatatatactgatttgtttgcccccagagaatttttaaggtatctgcctatatcgtgatcttttgaaatggtaaataaatctggtgcattaaaaatta

SEQ ID NO: 438926 - DNA, 1526 bp, Homo sapiens
gccgccgcccgcgacctcctctcctcctccgtcgtcaccccggccgccctgccagccccgaacttgcccgcgcctggccgcgcggcccctcagcccacggggctggcggcgcggttgggatgggaccgatgtggcgcatgcgtggtggcgccactaggcgcgggagttgctgcggcggggacggtgctgcggacggccgagggccaggccgctccggccgggctcgtggtgggggcagccccagcggcggcggcggcggcgtgggctggcgaggccgcgcggacggcgcccgacagcagctggaggagcggtttgccgacctggcggcgagccacttggaggccatccgtgcgcgggacgagtgggaccggcagaacgcgcggctgcgtcaggagaacgcccggctgcggctcgagaaccggcggctgaagcgcgagaaccgcagcctcttccgtcaggctttgcggctccccggcgaaggcggcaacgggacgcccgcggaggcacgccgggtccctgaagaggccagcacgaaccggagggctagagacagcggccgagaggacgagccgggcagccccagggccctgagggcccgacttgagaagctggaagccatgtaccgccgggccctgctgcagctgcacctcgagcagcggggaccacgtccgagcggggacaaggaggagcagcctctacagtgaacccgactccggcctccgctcccgggactcggagccctctgggccctggctgtagccgaggccgcagccggtgagaggcggagcctcggagcgggcccctcctcctccgttcccagctacccccgacctcgcgcacgccctggcccgcgccctgcccgcggataccttggactacggtgccttcccgcccccaccagtggacacttccgggtggcgcttggccatccgcttggtggaggtcgagtgggtgcaagggccctcaggacctcccacatgtacagttcccctgcctcttgccccggctagtttccctggagagaggcctagccaacaacgaagggacggattttaaaacagcgagaactgggtgccaagaaacacttcatattccctgaacttttctggatgttgtgcgaacctgttgtatttttttttttcctgtattttggttctgagggatgagtaatgtgtttttagttggttgagtttatccattcttcaatcccctaaagccttcagctattctttcatatgtggccaacattttaagtacagtgtttgcttttataagtcggtgttacttggatgtcctataaaatacccactttttataaagatgatatttataacctaggaactcatgcctgtcttggctgcagtccctgtacatctaatatatactgatttgtttgcccccagagaatttttaaggtatctgcctatatcgtgatcttttgaaatggtaaataaatctggtgcattaaaaattatctgaaaggttgcggcgagtattatttgaagtgtgttacatttttatatttt

SEQ ID NO: 438927 - DNA, 241 bp, Homo sapiens
gcggccgcctactactactactactgctcgaattcaagcttctaacgatgtacggggtcatgcctgtcttggctgcagtccctgtacatctaatatatactgatttgtttgcccccagagaatttttaaggtatctgcctatatcgtgatcttttgaaatggtaaataaatctggtgcattaaaaattatctgaaaggttgcggcgagtattatttgaagtgtgttacatttttatatttt

SEQ ID NO: 438928 - DNA, 612 bp, Homo sapiens
gccagggagtcgggtgtagggttggggtgcgattacgctgctagcagttacagtgcagaagaacgtggcggctgggattggggcgtggtcaggccatccacggcttccgagagacagagaagtcgcgctggtcagaagccagccgggccatcctgcagcgcgtgcaggcggccgcctttggccccggccagaccctgctctcctccgtgcacgtgctggacctggaagcccgcggctacatcaagccccacgtggacagcatcaagttctgcggggccaccatcgccggcctgtctctcctgtctcccagcgttatgcggctggtgcacacccaggagccgggggagtggctggaactcttgctggagccgggctccctctacatccttaggggctcagcccgttatgacttctcccatgagatccttcgggatgaagagtccttctttggggaacgccggattccccggggccggcgcatctccgtgatctgccgctccctccctgagggcatggggccaggggagtctggacagccgcccccagcctgctgacccccagctttctacagacaccagatttgtgaataaagttggggaatggacagcctaa

SEQ ID NO: 438929 - DNA, 464 bp, Homo sapiens
agctcaagagaggaggcgggttctggaaaaaggccaatagcctgtgaaggcgagtctagcagcaaccaatagctatgagcgagaggcgggactctgagggaagtcaatcgctgccgcaggtaccgccaatggcttttggcgggggcgttccccaaccctgccctctctcatgaccccgctccgggattatggccgggactgggctgctggcgctgcggacgctgccagggcccagctgggtgcgaggctcgggcccttccgtgctgagccgcctgcaggacgcggccgtggtgcggcctggcttcctgagcacggcagaggaggagacgctgagccgagaactggagcccgagctgcgccgccgccgctacgaatacgatcactgggacgcgaaaacgaccctacccgggaggacaatcggggacagatgtggttggagcatgaagaggaagagcagtagtaga

SEQ ID NO: 438930 - DNA, 983 bp, Homo sapiens
agctcaagagaggaggcgggttctggaaaaaggccaatagcctgtgaaggcgagtctagcagcaaccaatagctatgagcgagaggcgggactctgagggaagtcaatcgctgccgcaggtaccgccaatggcttttggcgggggcgttccccaaccctgccctctctcatgaccccgctccgggattatggccgggactgggctgctggcgctgcggacgctgccagggcccagctgggtgcgaggctcgggcccttccgtgctgagccgcctgcaggacgcggccgtggtgcggcctggcttcctgagcacggcagaggaggagacgctgagccgagaactggagcccgagctgcgccgccgccgctacgaatacgatcactgggacgcggccatccacggcttccgagagacagagaagtcgcgctggtcagaagccagccgggccatcctgcagcgcgtgcaggcggccgcctttggccccggccagaccctgctctcctccgtgcacgtgctggacctggaagcccgcggctacatcaagccccacgtggacagcatcaagttctgcggggccaccatcgccggcctgtctctcctgtctcccagcgttatgcggctggtgcacacccaggagccgggggagtggctggaactcttgctggagccgggctccctctacatccttaggggctcagcccgttatgacttctcccatgagatccttcgggatgaagagtccttctttggggaacgccggattccccggggccggcgcatctccgtgatctgccgctccctccctgagggcatggggccaggggagtctggacagccgcccccagcctgctgacccccagctttctacagacaccagatttgtgaataaagttggggaatggacagcctaaaaaaaaaaaaataattttatttttttctttatatataaatttatcatatttacttttatataaaaaaaaaa

SEQ ID NO: 438931 - DNA, 316 bp, Homo sapiens
agcagggggctggaatccaggaggctggaatccaggtctgcctggagcaggggctgccctccttgcacccagtcacagcctgtttcttcctgcaggggctcagcccgttatgacttctcccatgagatccttcgggatgaagagtccttctttggggaacgccggattccccggggccggcgcatctccgtgatctgccgctccctccctgagggcatggggccaggggagtctggacagccgcccccagcctgctgacccccagctttctacagacaccagatttgtgaataaagttggggaatggacagcctaa

SEQ ID NO: 438932 - DNA, 912 bp, Homo sapiens
agctcaagagaggaggcgggttctggaaaaaggccaatagcctgtgaaggcgagtctagcagcaaccaatagctatgagcgagaggcgggactctgagggaagtcaatcgctgccgcaggtaccgccaatggcttttggcgggggcgttccccaaccctgccctctctcatgaccccgctccgggattatggccgggactgggctgctggcgctgcggacgctgccagggcccagctgggtgcgaggctcgggcccttccgtgctgagccgcctgcaggacgcggccgtggtgcggcctggcttcctgagcacggcagaggaggagacgctgagccgagaactggagcccgagctgcgccgccgccgctacgaatacgatcactgggacgcggccatccacggcttccgagagacagagaagtcgcgctggtcagaagccagccgggccatcctgcagcgcgtgcaggcggccgcctttggccccggccagaccctgctctcctccgtgcacgtgctggacctggaagcccgcggctacatcaagccccacgtggacagcatcaagttctgcggggccaccatcgccggcctgtctctcctgtctcccagcgttatgcggctggtgcacacccaggagccgggggagtggctggaactcttgctggagccgggctccctctacatccttaggggctcagcccgttatgacttctcccatgagatccttcgggatgaagagtccttctttggggaacgccggattccccggggccggcgcatctccgtgatctgccgctccctccctgagggcatggggccaggggagtctggacagccgcccccagcctgctgacccccagctttctacagacaccagatttgtgaataaagttggggaatggacagcctaa

SEQ ID NO: 438933 - DNA, 863 bp, Homo sapiens
gccagggagtcgggtgtagggttggggtgcgattacgctgctagcagttacagtgcagaagaacgtggcggctgggattggggcgtggtcaggccatccacggcttccgagagacagagaagtcgcgctggtcagaagccagccgggccatcctgcagcgcgtgcaggcggccgcctttggccccggccagaccctgctctcctccgtgcacgtgctggacctggaagcccgcggctacatcaagccccacgtggacagcatcaagttctgcggggccaccatcgccggcctgtctctcctgtctcccagcgttatgcggctggtgcacacccaggagccgggggagtggctggaactcttgctggagccgggctccctctacatccttaggggctcagcccgttatgacttctcccatgagatccttcgggatgaagagtccttctttggggaacgccggattccccggggccggcgcatctccgtgatctgccgctccctccctgagggcatggggccaggggagtctggacagccgcccccagcctgctgacccccagctttctacagacaccagatttgtgaataaagttggggaatggacagcctaaaaaaaaaaaaaaaaaaaaaaaaaaaacaaaaaacaaacaaacacaaacaaaaaaacccgcagcggcgctccacattcacagcgggcgcgccgaaacagcaggggtcaaacaaaccggccaccgggggccaaaggggtgaaccgcagccccagtttccgtcgacccaagggaggacaaaacatcgcggagccccccataagagagcacggaacaaccacagcaaccacgcggggagaaccgcggcacatagg

SEQ ID NO: 438934 - DNA, 1133 bp, Homo sapiens
agctcaagagaggaggcgggttctggaaaaaggccaatagcctgtgaaggcgagtctagcagcaaccaatagctatgagcgagaggcgggactctgagggaagtcaatcgctgccgcaggtaccgccaatggcttttggcgggggcgttccccaaccctgccctctctcatgaccccgctccgggattatggccgggactgggctgctggcgctgcggacgctgccagggcccagctgggtgcgaggctcgggcccttccgtgctgagccgcctgcaggacgcggccgtggtgcggcctggcttcctgagcacggcagaggaggagacgctgagccgagaactggagcccgagctgcgccgccgccgctacgaatacgatcactgggacgcggccatccacggcttccgagagacagagaagtcgcgctggtcagaagccagccgggccatcctgcagcgcgtgcaggcggccgcctttggccccggccagaccctgctctcctccgtgcacgtgctggacctggaagcccgcggctacatcaagccccacgtggacagcatcaagttctgcggggccaccatcgccggcctgtctctcctgtctcccagcgttatgcggctggtgcacacccaggagccgggggagtggctggaactcttgctggagccgggctccctctacatccttaggggctcagcccgttatgacttctcccatgagatccttcgggatgaagagtccttctttggggaacgccggattccccggggccggcgcatctccgtgatctgccgctccctccctgagggcatggggccaggggagtctggacagccgcccccagcctgctgacccccagctttctacagacaccagatttgtgaataaagttggggaatggacagcctaactgggacattgcagtggctgcttgctggggccgggatttgcaggggaacccaggatggcactggcccatagggagctccaggtgtggctggctggacacatggtcaaagtcacaaggccgggagagtggtgtcctttattgcactcactgctggtcgccccagcccactcccctcctcgttgtctctgcatccaggtctccaataaataagtcagccgagc

SEQ ID NO: 438935 - DNA, 662 bp, Homo sapiens
gtggggaatagaaaggtccccttcaactaaggtataacctgccctaacaagcctgaaatagttctctaggcggccctcagcaagtgcatgctgcgggtgccaggctcaaaagggagcaccggtggttttaacaggggtcattgcttccgcaggcgcaaacacatgtttcacggggtgtcttggggggttctaaccgcagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438936 - DNA, 1416 bp, Homo sapiens
ggatccccgggctgcaggattcggcacgaggagaagtgcatcttatgaaacagtcttagcagtggtaggttgggaaggagatagctgcaaccaaaaaagaaataaatattctataaaccttcagctgctatcgggtttcacttttctgctcttgctgtccaaagactcagtgtatttcattacttttgactctactagacatgactgggtttcaacagtaaaggtcttcaactcttgctagtcattggaatcaagccgcaaaattttaaaaactgagatgctcaggccacaccccagctcaattaaatcagaaaccctagacttgggatcctctaactattagatttcttaaagctccctcagtaattccaatgtacagtcaagtttgagaactaccaatctaaatttcaagtttgagggtatttgaaaattaaagccattcacaatacgaagccagctaaaaatgtagaatgattttgagcaacttgtggagtataataagagaattaatgtgacttcaatgcttggagcattcttgttcaagtggcccaggtttggtgaaacaggactaccttgtcatctgcacgtccaggcatatttcgtagttttgcagtaaataatattcacataatgatactgtattgactttcaattttcagaattaacctatagttacagcacttaagacaaccagagttataaaagagaatttaaatattataactttggacaatataaaagtgatgatttaactgacagaagctaggaaatataagggggaggagaagtggaagaaagcaaagagagtcaggaatactacttaaaactgatgggttaagaaatagtgctttaattctatttaagtaataaaagaaatggatgtaaatcataaaaatatatatctaaaattaaaatattgatggtagtatgctaaatttcttaccttgaataatacaaagacaaatggtattgtgtagattaacaaatgaagaaacagagacttaacatattatttagaggaataagacagaattagccaaaggggcttactctaagacctgggagaaagacctgggagtcagggcacaggaaagatgacatttccttattacctgccctctacagtatttgaatatttatttccatgtacttgtcattacttttctaaaaacaactacagacagtcatacaagcaactcaagcctatatgagagatctattaagcccacggttttcattttacaggtgataaaaccaagtccagagaagtaaaattacttactgaggatcccacatttatagcagagctgagagattaaaattcaggtcttctgaactcaagtctcttgctcaaaaagtggatacacagccagagatcttacagggcaaggtgacaggctgtgttcaatatctctg

SEQ ID NO: 438937 - DNA, 416 bp, Homo sapiens
ggcacgagggaaattcgacacaattagatttaacatgtgttgtatttccagcagttcaaatctaattgtgtcgaatttccaggattgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438938 - DNA, 632 bp, Homo sapiens
ccgagttccaatccaaataattctttggaggatggtgaccagatgctaaagtttccaacacatactaaaatgtctctgggtccgagttaagtttgattttcttctgtgagtactatgttggggttactagagttgtggacagctggagatccccaattagaactctaaacactgcttgaatttcttcattaacccaacttagagacatctttcttaatgatttatgcttagatgccctaaaaaggcagtagctaggttctgaggcagctagaataatctctagaaagaaatacagtaattacgggtttgtatttattttttatctcattctgaaaaattctactgtctttaagtcatctatgtagtatttctccataatggcttcaatttataccaattgcaactgttgaatctcctcctaaggaaaggataacagtgagcacagcttcacttttgcttccttgattttcctttttagaatggactggtacctattgttgaaccagaggtaattcctgatggagaccatgacctggaacactgccagtatgttactgagaaggtaagttttaaatatgaaggccccaattctagttgaaaaattagcctttaggatggatagcatagagaag

SEQ ID NO: 438939 - DNA, 1609 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438940 - DNA, 1588 bp, Homo sapiens
  misc_feature (43)..(43): n is a, c, g, or t
  misc_feature (45)..(45): n is a, c, g, or t
  misc_feature (47)..(47): n is a, c, g, or t
gggggggggagggggggggggcggggaccgggagacgtccttncnancgcgagctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaagggaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438941 - DNA, 2902 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttcagctgctatcgggtttcacttttctgctcttgctgtccaaagactcagtgtatttcattacttttgactctactagacatgactgggtttcaacagtaaaggtcttcaactcttgctagtcattggaatcaagccgcaaaattttaaaaactgagatgctcaggccacaccccagctcaattaaatcagaaaccctagacttgggatcctctaactattagatttcttaaagctccctcagtaattccaatgtacagtcaagtttgagaactaccaatctaaatttcaagtttgagggtatttgaaaattaaagccattcacaatacgaagccagctaaaaatgtagaatgattttgagcaacttgtggagtataataagagaattaatgtgacttcaatgcttggagcattcttgttcaagtggcccaggtttggtgaaacaggactaccttgtcatctgcacgtccaggcatatttcgtagttttgcagtaaataatattcacataatgatactgtattgactttcaattttcagaattaacctatagttacagcacttaagacaaccagagttataaaagagaatttaaatattataactttggacaatataaaagtgatgatttaactgacagaagctaggaaatataagggggaggagaagtggaagaaagcaaagagagtcaggaatactacttaaaactgatgggttaagaaatagtgctttaattctatttaagtaataaaagaaatggatgtaaatcataaaaatatatatctaaaattaaaatattgatggtagtatgctaaatttcttaccttgaataatacaaagacaaatggtattgtgtagattaacaaatgaagaaacagagacttaacatattatttagaggaataagacagaattagccaaaggggcttactctaagacctgggagaaagacctgggagtcagggcacaggaaagatgacatttccttattacctgccctctacagtatttgaatatttatttccatgtacttgtcattacttttctaaaaacaactacagacagtcatacaagcaactcaagcctatatgagagatctattaagcccacggttttcattttacaggtgataaaaccaagtccagagaagtaaaattacttactgaggatcccacatttatagcagagctgagagattaaaattcaggtcttctgaactcaagtctcttgctcaaaaagtggatacacagccagagatcttacagggcaaggtgacaggctgtgttcaatatctctg

SEQ ID NO: 438942 - DNA, 2850 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctcattagctgagtgtagagaagtgcatcttatgaaacagtcttagcagtggtaggttgggaaggagatagctgcaaccaaaaaagaaataaatattctataaaccttcagctgctatcgggtttcacttttctgctcttgctgtccaaagactcagtgtatttcattacttttgactctactagacatgactgggtttcaacagtaaaggtcttcaactcttgctagtcattggaatcaagccgcaaaattttaaaaactgagatgctcaggccacaccccagctcaattaaatcagaaaccctagacttgggatcctctaactattagatttcttaaagctccctcagtaattccaatgtacagtcaagtttgagaactaccaatctaaatttcaagtttgagggtatttgaaaattaaagccattcacaatacgaagccagctaaaaatgtagaatgattttgagcaacttgtggagtataataagagaattaatgtgacttcaatgcttggagcattcttgttcaagtggcccaggtttggtgaaacaggactaccttgtcatctgcacgtccaggcatatttcgtagttttgcagtaaataatattcacataatgatactgtattgactttcaattttcagaattaacctatagttacagcacttaagacaaccagagttataaaagagaatttaaatattataactttggacaatataaaagtgatgatttaactgacagaagctaggaaatataagggggaggagaagtggaagaaagcaaagagagtcaggaatactacttaaaactgatgggttaagaaatagtgctttaattctatttaagtaataaaagaaatggatgtaaatcataaaaatatatatctaaaattaaaatattgatggtagtatgctaaatttcttaccttgaataatacaaagacaaatggtattgtgtagattaacaaatgaagaaacagagacttaacatattatttagaggaataagacagaattagccaaaggggcttactctaagacctgggagaaagacctgggagtcagggcacaggaaagatgacatttccttattacctgccctctacagtatttgaatatttatttccatgtacttgtcattacttttctaaaaacaactacagacagtcatacaagcaactcaagcctatatgagagatctattaagcccacggttttcattttacaggtgataaaaccaagtccagagaagtaaaattacttactgaggatcccacatttatagcagagctgagagattaaaattcaggtcttctgaactcaagtctcttgctcaaaaagtggatacacagccagagatcttacagggcaaggtgacaggctgtgttcaatatctctg

SEQ ID NO: 438943 - DNA, 1601 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtgggttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438944 - DNA, 2848 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgccctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttcagctgctatcgggtttcacttttctgctcttgctgtccaaagactcagtgtatttcattacttttgactctactagacatgactgggtttcaacagtaaaggtcttcaactcttgctagtcattggaatcaagccgcaaaattttaaaaactgagatgctcaggccacaccccagctcaattaaatcagaaaccctagacttgggatcctctaactattagatttcttaaagctccctcagtaattccaatgtacagtcaagtttgagaactaccaatctaaatttcaagtttgagggtatttgaaaattaaagccattcacaatacgaagccagctaaaaatgtagaatgattttgagcaacttgtggagtataataagagaattaatgtgacttcaatgcttggagcattcttgttcaagtggcccaggtttggtgaaacaggactaccttgtcatctgcacgtccaggcatatttcgtagttttgcagtaaataatattcacataatgatactgtattgactttcaattttcagaattaacctatagttacagcacttaagacaaccagagttataaaagagaatttaaatattataactttggacaatataaaagtgatgatttaactgacagaagctaggaaatataagggggaggagaagtggaagaaagcaaagagagtcaggaatactacttaaaactgatgggttaagaaatagtgctttaattctatttaagtaataaaagaaatggatgtaaatcataaaaatatatatctaaaattaaaatattgatggtagtatgctaaatttcttaccttgaataatacaaagacaaatggtattgtgtagattaacaaatgaagaaacagagacttaacatattatttagaggaataagacagaattagccaaaggggcttactctaagacctgggagaaagacctgggagtcagggcacaggaaagatgacatttccttattacctgccctctacagtatttgaatatttatttccatgtacttgtcattacttttctaaaaacaactacagacagtcatacaagcaactcaagcctatatgagagatctattaagcccacggttttcattttacaggtgataaaaccaagtccagagaagtaaaattacttactgaggatcccacatttatagcagagctgagagattaaaattcaggtcttctgaactcaagtctcttgctcaaaaagtggatacacagccagagatcttacagggcaaggtgacaggctgtgttcaatatctctg

SEQ ID NO: 438945 - DNA, 1555 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgccctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438946 - DNA, 1412 bp, Homo sapiens
ccgagttccaatccaaataattctttggaggatggtgaccagatgctaaagtttccaacacatactaaaatgtctctgggtccgagttaagtttgattttcttctgtgagtactatgttggggttactagagttgtggacagctggagatccccaattagaactctaaacactgcttgaatttcttcattaacccaacttagagacatctttcttaatgatttatgcttagatgccctaaaaaggcagtagctaggttctgaggcagctagaataatctctagaaagaaatacagtaattacgggtttgtatttattttttatctcattctgatttataccaattgcaactgttgaatctcctcctaaggaaaggataacagtgagcacagcttcacttttgcttccttgattttcctttttagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438947 - DNA, 1499 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggcagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438948 - DNA, 2740 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggcagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctcattagctgagtgtagagaagtgcatcttatgaaacagtcttagcagtggtaggttgggaaggagatagctgcaaccaaaaaagaaataaatattctataaaccttcagctgctatcgggtttcacttttctgctcttgctgtccaaagactcagtgtatttcattacttttgactctactagacatgactgggtttcaacagtaaaggtcttcaactcttgctagtcattggaatcaagccgcaaaattttaaaaactgagatgctcaggccacaccccagctcaattaaatcagaaaccctagacttgggatcctctaactattagatttcttaaagctccctcagtaattccaatgtacagtcaagtttgagaactaccaatctaaatttcaagtttgagggtatttgaaaattaaagccattcacaatacgaagccagctaaaaatgtagaatgattttgagcaacttgtggagtataataagagaattaatgtgacttcaatgcttggagcattcttgttcaagtggcccaggtttggtgaaacaggactaccttgtcatctgcacgtccaggcatatttcgtagttttgcagtaaataatattcacataatgatactgtattgactttcaattttcagaattaacctatagttacagcacttaagacaaccagagttataaaagagaatttaaatattataactttggacaatataaaagtgatgatttaactgacagaagctaggaaatataagggggaggagaagtggaagaaagcaaagagagtcaggaatactacttaaaactgatgggttaagaaatagtgctttaattctatttaagtaataaaagaaatggatgtaaatcataaaaatatatatctaaaattaaaatattgatggtagtatgctaaatttcttaccttgaataatacaaagacaaatggtattgtgtagattaacaaatgaagaaacagagacttaacatattatttagaggaataagacagaattagccaaaggggcttactctaagacctgggagaaagacctgggagtcagggcacaggaaagatgacatttccttattacctgccctctacagtatttgaatatttatttccatgtacttgtcattacttttctaaaaacaactacagacagtcatacaagcaactcaagcctatatgagagatctattaagcccacggttttcattttacaggtgataaaaccaagtccagagaagtaaaattacttactgaggatcccacatttatagcagagctgagagattaaaattcaggtcttctgaactcaagtctcttgctcaaaaagtggatacacagccagagatcttacagggcaaggtgacaggctgtgttcaatatctctg

SEQ ID NO: 438949 - DNA, 1218 bp, Homo sapiens
aggaatgacattgaccaagggagtaatggaaataaaggaatgaagggcttctaggaagcagagccatgcctgtcattcatgcagtgaatgagaagctagattaggggtgatgaagacaggccagtttagttgtgctcagtggctatggattgcaacacattggtctaatgaggcctggagattggttcagaagcttttgccaagcaacaaataagaattccttcatcctgcctccctgcagtgtaaatgtgccaaggtcaagtggctctatgactagctttgagtttcacctggtgggacctcttgtccttcaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438950 - DNA, 1592 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatgcagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438951 - DNA, 751 bp, Homo sapiens
gaaatggcttctctcctaccaggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438952 - DNA, 774 bp, Homo sapiens
ggcacgagaatttttcaactttagtttctagtactgttgctgcaatattgttggtactgaacagagatttccccagtaactgacacaaacctcaagcttaccaaagaaatgctcagaaaactgggataaaaaggggagatactttatagaaggggatggtatccccagcaatattcagcaacattgctgtagaagtggggtcacatttactctaaccagtctcctctctcatatttgtcttctaggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438953 - DNA, 1232 bp, Homo sapiens
  misc_feature (43)..(43): n is a, c, g, or t
  misc_feature (45)..(45): n is a, c, g, or t
  misc_feature (47)..(47): n is a, c, g, or t
gggggggggagggggggggggcggggaccgggagacgtccttncnancgcgagctgcctcacccacagcttttgatatctaggaggactcttctctcccaaactacctgtcaccatggcccaccgatttccagccctcacccaggagcagaagaaggagcagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438954 - DNA, 2015 bp, Homo sapiens
ggcacgagaatttttcaactttagtttctagtactgttgctgcaatattgttggtactgaacagagatttccccagtaactgacacaaacctcaagcttaccaaagaaatgctcagaaaactgggataaaaaggggagatactttatagaaggggatggtatccccagcaatattcagcaacattgctgtagaagtggggtcacatttactctaaccagtctcctctctcatatttgtcttctaggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctcattagctgagtgtagagaagtgcatcttatgaaacagtcttagcagtggtaggttgggaaggagatagctgcaaccaaaaaagaaataaatattctataaaccttcagctgctatcgggtttcacttttctgctcttgctgtccaaagactcagtgtatttcattacttttgactctactagacatgactgggtttcaacagtaaaggtcttcaactcttgctagtcattggaatcaagccgcaaaattttaaaaactgagatgctcaggccacaccccagctcaattaaatcagaaaccctagacttgggatcctctaactattagatttcttaaagctccctcagtaattccaatgtacagtcaagtttgagaactaccaatctaaatttcaagtttgagggtatttgaaaattaaagccattcacaatacgaagccagctaaaaatgtagaatgattttgagcaacttgtggagtataataagagaattaatgtgacttcaatgcttggagcattcttgttcaagtggcccaggtttggtgaaacaggactaccttgtcatctgcacgtccaggcatatttcgtagttttgcagtaaataatattcacataatgatactgtattgactttcaattttcagaattaacctatagttacagcacttaagacaaccagagttataaaagagaatttaaatattataactttggacaatataaaagtgatgatttaactgacagaagctaggaaatataagggggaggagaagtggaagaaagcaaagagagtcaggaatactacttaaaactgatgggttaagaaatagtgctttaattctatttaagtaataaaagaaatggatgtaaatcataaaaatatatatctaaaattaaaatattgatggtagtatgctaaatttcttaccttgaataatacaaagacaaatggtattgtgtagattaacaaatgaagaaacagagacttaacatattatttagaggaataagacagaattagccaaaggggcttactctaagacctgggagaaagacctgggagtcagggcacaggaaagatgacatttccttattacctgccctctacagtatttgaatatttatttccatgtacttgtcattacttttctaaaaacaactacagacagtcatacaagcaactcaagcctatatgagagatctattaagcccacggttttcattttacaggtgataaaaccaagtccagagaagtaaaattacttactgaggatcccacatttatagcagagctgagagattaaaattcaggtcttctgaactcaagtctcttgctcaaaaagtggatacacagccagagatcttacagggcaaggtgacaggctgtgttcaatatctctg

SEQ ID NO: 438955 - DNA, 384 bp, Homo sapiens
caacctccacctcctggattcaagcaattcttctgcctcagcctcccaagtagctgggactagaggcatgcgccaccatacctggctaatttctgtatattttagtaaagatggggtttcaccatgttggccaggctggtctcaaactcctgacctcaggtgatctgcccacctcaacctcccaaagtgctgagattacagacatgagccaccacacccagccgggtaaacaatttcaaagggccaataataacatgctatagagagattcaaaagaaaggccaagaaaagaccctgagattggcatttaggagcataccagtgaccctcactgaaacagtttcaataaagaggaaaggaaaggtgcccactcaagaagttttt

SEQ ID NO: 438956 - DNA, 154 bp, Homo sapiens
gctgcccttggccctcccaccataggtaccatggggaaccgcctgcagaggatcaaggtggaaaacactgaagagaaccgccggcagttccgagaaatcctcttctctgtggacagttccatcaaccagagcatcgggggtgtgatccttttcc

SEQ ID NO: 438957 - DNA, 324 bp, Homo sapiens
gtggggtcacatttactctaaccagtctcctctctcatatttgtcttctaggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatg

SEQ ID NO: 438958 - DNA, 1655 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438959 - DNA, 648 bp, Homo sapiens
  misc_feature (522)..(522): n is a, c, g, or t
ggatccccgggctgcaggattcggcacgaggtgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtgggttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtcatcagctngtatcagaaacgcacgcctgctcgtcgcagattgcacagatgctgtctatgtgacaagtatctgtggactgctgacatgcgtgtctgaagctgtgtgtcagctatgctagtactgagacttagcac

SEQ ID NO: 438960 - DNA, 1599 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaagggaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438961 - DNA, 1593 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggaaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438962 - DNA, 2848 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacatatttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttcagctgctatcgggtttcacttttctgctcttgctgtccaaagactcagtgtatttcattacttttgactctactagacatgactgggtttcaacagtaaaggtcttcaactcttgctagtcattggaatcaagccgcaaaattttaaaaactgagatgctcaggccacaccccagctcaattaaatcagaaaccctagacttgggatcctctaactattagatttcttaaagctccctcagtaattccaatgtacagtcaagtttgagaactaccaatctaaatttcaagtttgagggtatttgaaaattaaagccattcacaatacgaagccagctaaaaatgtagaatgattttgagcaacttgtggagtataataagagaattaatgtgacttcaatgcttggagcattcttgttcaagtggcccaggtttggtgaaacaggactaccttgtcatctgcacgtccaggcatatttcgtagttttgcagtaaataatattcacataatgatactgtattgactttcaattttcagaattaacctatagttacagcacttaagacaaccagagttataaaagagaatttaaatattataactttggacaatataaaagtgatgatttaactgacagaagctaggaaatataagggggaggagaagtggaagaaagcaaagagagtcaggaatactacttaaaactgatgggttaagaaatagtgctttaattctatttaagtaataaaagaaatggatgtaaatcataaaaatatatatctaaaattaaaatattgatggtagtatgctaaatttcttaccttgaataatacaaagacaaatggtattgtgtagattaacaaatgaagaaacagagacttaacatattatttagaggaataagacagaattagccaaaggggcttactctaagacctgggagaaagacctgggagtcagggcacaggaaagatgacatttccttattacctgccctctacagtatttgaatatttatttccatgtacttgtcattacttttctaaaaacaactacagacagtcatacaagcaactcaagcctatatgagagatctattaagcccacggttttcattttacaggtgataaaaccaagtccagagaagtaaaattacttactgaggatcccacatttatagcagagctgagagattaaaattcaggtcttctgaactcaagtctcttgctcaaaaagtggatacacagccagagatcttacagggcaaggtgacaggctgtgttcaatatctctg

SEQ ID NO: 438963 - DNA, 1570 bp, Homo sapiens
cgcacacacagcacacacacgagcacataacacacaaacgcacagcacacgcacacacatgcacacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438964 - DNA, 1326 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtgggttccatcaaccagagcatcgggggtgtgatccttttccacgagaccctctaccagaaggacagcaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438965 - DNA, 1546 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatgcagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttca

SEQ ID NO: 438966 - DNA, 2646 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgcccctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttcagctgctatcgggtttcacttttctgctcttgctgtccaaagactcagtgtatttcattacttttgactctactagacatgactgggtttcaacagtaaaggtcttcaactcttgctagtcattggaatcaagccgcaaaattttaaaaactgagatgctcaggccacaccccagctcaattaaatcagaaaccctagacttgggatcctctaactattagatttcttaaagctccctcagtaattccaatgtacagtcaagtttgagaactaccaatctaaatttcaagtttgagggtatttgaaaattaaagccattcacaatacgaagccagctaaaaatgtagaatgattttgagcaacttgtggagtataataagagaattaatgtgacttcaatgcttggagcattcttgttcaagtggcccaggtttggtgaaacaggactaccttgtcatctgcacgtccaggcatatttcgtagttttgcagtaaataatattcacataatgatactgtattgactttcaattttcagaattaacctatagttacagcacttaagacaaccagagttataaaagagaatttaaatattataactttggacaatataaaagtgatgatttaactgacagaagctaggaaatataagggggaggagaagtggaagaaagcaaagagagtcaggaatactacttaaaactgatgggttaagaaatagtgctttaattctatttaagtaataaaagaaatggatgtaaatcataaaaatatatatctaaaattaaaatattgatggtagtatgctaaatttcttaccttgaataatacaaagacaaatggtattgtgtagattaacaaatgaagaaacagagacttaacatattatttagaggaataagacagaattagccaaaggggcttactctaagacctgggagaaagacctgggagtcagggcacaggaaagatgacatttccttattacctgccctctacagtatttgaatatttatttccatgtacttgtcattacttttctaaaaacaactacagacagtcatacaagcaactcaagcctatatgagagatctattaagcccacggttttcattttacaggtgataaaaccaagtccagagaagtaaaattacttactgaggatcccacatttatagcagagctgagagattaaaattcaggtcttctgaactcaagtctcttgctcaaaaagtggatacacagccagagatcttacagggcaaggtgacaggctgtgttcaatatctctg

SEQ ID NO: 438967 - DNA, 1938 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggtaagatgctgccacctcttatctacttgatgatgttcacatttggggcttgactttccaacacggagaagcattgttttcttcgggccaagaaggtatctaccaatagtgtctattaggcatttgaaaatgtggcagtagaggtcagtatgaggattgaggctagagagaattttgaattatccacactagagtatagttgatgacaggagactgaaggacaatttcaacagaaacacttcagagggaaggagataagaggaccaagaactgaacctaggatactttttattttgggaagatgaagaagagaagcaaccaagaaaagcagcgattatattgtagggtgaaccaagcattctgggaataaagacagaagaatttctttctttcatgtttatttgtttgtttgtttgtttgttttgagatggagtgttactctgtcacccaggctggagtacagtggcacaatctcggctcactgcaacctccacctcctggattcaagcaattcttctgcctcagcctcccaagtagctgggactagaggcatgcgccaccatacctggctaatttctgtatattttagtaaagatggggtttcaccatgttggccaggctggtctcaaactcctgacctcaggtgatctgcccacctcaacctcccaaagtgctgagattacagacatgagccaccacacccagccgggtaaacaatttcaaagggccaataataacatgctatagagagattcaaaagaaaggccatttcaataaagaggaaaggaaaggtgcccactcaagaagtttttcagaaaaagacccagaaaggttgccaggagaaatgaggaccaacaa

SEQ ID NO: 438968 - DNA, 1015 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgcccttgccaaggttccaaccaaggaggcacccaagaaggctttaatccggcccatggttcctgcg

SEQ ID NO: 438969 - DNA, 848 bp, Homo sapiens
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggagaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagtctgcgagcacaatggacttggaccctattgtttacaccagagggtaattcctgaggggagaacattaacctggggcacttggcagttcgttacctaagaagggcttggcctgcttgatgccggtgccctgagatgaccattgaggtgagccttgaaggataccttccatgggccctcgtc

SEQ ID NO: 438970 - DNA, 760 bp, Homo sapiens
gttccaagtaggggagaccagctgcccctgaaccccagaacaaccagctggatcagttctcacaggagctacagcgcggagactgggaaacatggttccaaaactgttcacttcccaaatttgtctgcttcttctgttggggcttctggctgtggagggctcactccatgtcaaacctccacagtttacctgggctcaatggtttgaaacccagcacatcaatatgacctcccagcaatgcaccaatgcaatgcaggtcattaacaattatcaacggcgatgcaaaaaccaaaatactttccttcttacaacttttgctaacgtagttaatgtttgtggtaacccaaatatgacctgtcctagtaacaaaactcgcaaaaattgtcaccacagtggaagccaggtgcctttaatccactgtaacctcacaactccaagtccacagaatatttcaaactgcaggtatgcgcagacaccagcaaacatgttctatatagttgcatgtgacaacagagatcaacgacgagaccctccacagtatccggtggttccagttcacctggatagaatcatctaagctcctgtatcagcactcctcatcatcactcatctgccaagctcctcaatcatagccaagatcccatctctccatatactttgggtatcagcatctgtcctcatcagtctccataccccttcagctttcctgagctgaagtgccttgtgaaccctgcaataaactgctttgcaaattcaaaaa

SEQ ID NO: 438971 - DNA, 503 bp, Homo sapiens
caatgacacggtgatgctcactacgcaacagatacttaccttcttacactataggctaccttcgtgcatgtaagttgtgtaccccggactatgatctgatcctagtgcgaataggcgaaacactgtgtgaccacagtggaagccaggtgcctttaatccactgtaacctcacaactccaagtccacagaatatttcaaactgcaggtatgcgcagacaccagcaaacatgttctatatagttgcatgtgacaacagagatcaacgacgagaccctccacagtatccggtggttccagttcacctggatagaatcatctaagctcctgtatcagcactcctcatcatcactcatctgccaagctcctcaatcatagccaagatcccatctctccatatactttgggtatcagcatctgtcctcatcagtctccataccccttcagctttcctgagctgaagtgccttgtgaaccctgcaataaactgctttgcaaattcaaaaa

SEQ ID NO: 438972 - DNA, 309 bp, Homo sapiens
aatgcagagaatatacaagatcctcctctggcagtagggggaccaggaactatgttctgctcttgtgcccttctgagcccacaataaaggctgagctcttatcttgcaaaaaaggctgctggtgcactgtgtcgtagggctgagatggcaacggtgggcaggggctgagttctgagaccggttctgaggaaggaagcacaggccccatctgcaagcctcagtgtcagtgtgagatactgccaacttctggggaagagtgatgtctttgcctccaggggtgggaaaggcatagcatggggtaggcctctt

SEQ ID NO: 438973 - DNA, 8832 bp, Homo sapiens
gcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaaagaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaa

SEQ ID NO: 438974 - DNA, 9074 bp, Homo sapiens
gcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagagaccaggtgcctgcaaatgccatctcctgttggggaattaagaagcataaaggtggcacagaactgtcctatattatgggggcacaggatgaggaggaaggaatccaagacttggatggattattagttttcgataagattgtggaggtcaccttgttgaacctcccatggtacaatgaagagactgagggtcagagaggagaaatgactgctccaaagtctcctagagccaaaatcagagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaaagaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaa

SEQ ID NO: 438975 - DNA, 8667 bp, Homo sapiens
gcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaaagaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaa

SEQ ID NO: 438976 - DNA, 9277 bp, Homo sapiens
gcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaaagaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttggtcatgactagtctgagcacaggtgtccatatactggaggtggggactcaggagaggaaagtgagatggaacccagggccctcaggtaacatgaacgtcgtgggggccatagtcaaggtggcagggtgtggctgtcataatggggagggaaggtgctcgttgctctcaccctggcttctcactggacttgcctctgggaaactggcctttggggaggtgagaaggagtcctcagggtgagctctgagccctctgaagtcctgctcataagtagggagcatttattaaaatccagatctattcaacaccactccctgacactaatcaagccttctgggagcttaaacttgagaacgtaaattcgctggggaggggctatggtcacagctgctagagtcagatcctgccgccaccatctgtacaaacaagaatgaacactgcctgggccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaa

SEQ ID NO: 438977 - DNA, 5509 bp, Homo sapiens
attccctctttgagaccattgagctacatttctccttctacctggacccccttatccttaaattgaccatcagaacatttgcacccagactaagagccagagttcctgacacctggccataggcctgggccacctgaggctgcctttgcaggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaa

SEQ ID NO: 438978 - DNA, 1847 bp, Homo sapiens
tggacagccaaggagagcgggcgagtgtagggctggcgctgccggacgcggtgctagtcgccggatgaagtgagggcctcaccccaacgcagccttagcctcctctgtgctgtccggacagcacagaggaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaa

SEQ ID NO: 438979 - DNA, 1351 bp, Homo sapiens
ccaccctttgatgaacacaagtgtctggctgagggaggtaaaattatgaaagttccaggcacctgctgtgacacatgtgaggagcctgagtgcaacgacatcactgccaggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaa

SEQ ID NO: 438980 - DNA, 8312 bp, Homo sapiens
  misc_feature (8058)..(8058): n is a, c, g, or t
  misc_feature (8088)..(8088): n is a, c, g, or t
gcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaaagaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcaggcancgtgttacgatgatgggaagacataccacntaggagaacagtggcagaaggaatatctcggtgccatttgctcctgcacatgctttggaggccagcggggctggcgctgtgacaactgccgcagaccctggggtgaacccagttcccgaggcactactggccagtcctaccaccagttttcttagagattccatcagagaacaaccctaaggttaatggccaattgagggcttatgccttagatggacagctgg

SEQ ID NO: 438981 - DNA, 7599 bp, Homo sapiens
  misc_feature (7292)..(7292): n is a, c, g, or t
  misc_feature (7308)..(7308): n is a, c, g, or t
  misc_feature (7374)..(7374): n is a, c, g, or t
gcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaaagaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcacttgcccttcttgtctctgcccanacattcacggcatggngtaactcccacctccggaaggcggggacacagatcgagaacatcgaagaggacttccgggatggcntgaagctcatgctgctgctggaggtcatctcaggtgaggcggaacctggcccaggacgagatactgtctattggtgctgcctgacaccttggcatctgctctgcctatgagcgcagctggttttggtctcttgaaacaagttggggatgacatgtatgaattcatcctaggagcgtgggtctgagttttggttctgctgccagccatccaggtgccttggacatc

SEQ ID NO: 438982 - DNA, 3945 bp, Homo sapiens
gcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaaagaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtgaggaccttgagggtagtgggaagcagacggtcccaaggcttggcctggtggtatggacacagagtgtgaccttctaacgtggacactaccctcgtgtcttgacatgatctgcaccaagacaccacttcggctttttttcttggctttcaatctgggaaacaaaaagtaaaatcaacagtttctaggggaagcaatgcctggcaaaacatttccttctgcatgagaagtaactccccttggcatgtgccaatgcttctctttcagccccagtcttaggatttgttctcttattgaagtatcttgttttcaacaccagagccagagatttccttttcctgtcactgctgcatttgtccagaccaaaagaccttcctctcccaccccctaaaaccccttggtgcccatttcttgtctcacagaaattcttttctggccttaattttggtgattttgagtcctcgtattatg

SEQ ID NO: 438983 - DNA, 760 bp, Homo sapiens
  misc_feature (37)..(37): n is a, c, g, or t
tgacactaagaaaagtttgtaaaaaaagaggtggtanggtcggaattcccgggatgacctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccaggtaggtacaaaagggcctccatttctcattcctgccccagggccatctggagtgacacctttccgggaatcagcaggtgtgtctggagctcacctgtgtgcccagccctaacttaggctgttggttgcctcctgtgaaggttctgcggagttcccacccttgacttgtattccagagaccaggtgcctgcaaatgccatctcctgttggggaattaagaagcataaaggtggcacagaactgtcctatattatgggggcacaggatgaggaggaaggaatccaagacttggatggattattagttttcgataagattgtggaggtcaccttgttgaacctcccatggtacaatgaagagactgagggtcagagaggagaaatgactgctccaaagtctcctagagccaaaatcagaggtcagtcttcctgggttccaggccaacaccctttccactgcactgcatcatactgctgcccttcccttgctaagattctgggtctgcaaatggcgggaggggacttttgaccttgggcgctttc

SEQ ID NO: 438984 - DNA, 378 bp, Homo sapiens
tcacagctacaaggggtggcaagtcctagaaccacagtccttgctgtccaacattcccgctgaggccttacttcttctcctctctcttctagagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtggtaagtgcaggcagcaagtgtcagggacctctaaaaacagcagag

SEQ ID NO: 438985 - DNA, 250 bp, Homo sapiens
ggaccttgacctcggacccttatgactttgccaactcatgggctctgagcagtggagaacagtggtgtgaacgggcatctcctcccagcagctcatgcaacatctcctctggggaaatgcagaaggtgggtgtggactggcctgggtgcacctggatggtgtgtgatttctggatctaaaagacagaaggactcagtctcatatccttccatctgggggaggaatggacttacgcagggccatttcctcc

SEQ ID NO: 438986 - DNA, 379 bp, Homo sapiens
gctgtggcatggctggtgagatgatgcaccggtgggacctgccctgggtagacccctttgatgttccttttcaggcccagtgtgccctgctggtatggagtataggcagtgtgtgtccccttgcgccaggacctgccagagcctgcacatcaaagaaatgtgtcaggagcgatgcgtggatggctgcagctgccctggtaatgaacttcccactttatttacagatcagagaccttgccagcacccttggctttgggaagtgagatgaaggccacttgtgtttgctccccgttgctgaaatcagaagccttttattaagtttttaaatgtctttgtccagcgtgatcaggattgagctggtctttatttttaatgtacg

SEQ ID NO: 438987 - DNA, 659 bp, Homo sapiens
ttccctctttgagaccattgagctacatttctccttctacctggacccccttatccttaaattgaccatcagaacatttgcacccagactaagagccagagttcctgacacctggccataggcctgggccacctgaggctgcctttgcaggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgccgtgagtactgacgccctcatgttctcagatgccctcccttcttcccatgtgtctatgcttgaagaccttgtgagtgcagggggatatcttcatgggcgagagaagacagagtgttagtagggactggatggccaagggctaaggagggttaagacattggctgtgtaagaagtttatattacgggtgaggtgggacatggattcaaggcatgaacatgtggagacttttcttctggagagattctggcaggggagaagagggaatactgatgaaaagaaggaagtcgatttatgtctttaattaggcgtgattatatttgccaatatgagtgatcaactcatacattcatgt

SEQ ID NO: 438988 - DNA, 8928 bp, Homo sapiens
gcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagcaccattgtccagcagctgagtttcccagggaccttggagatagccgcagccctcatttatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaaagaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaatgcatgttctgctcttgtgcccttctgagcccacaat

SEQ ID NO: 438989 - DNA, 8744 bp, Homo sapiens
  misc_feature (37)..(37): n is a, c, g, or t
tgacactaagaaaagtttgtaaaaaaagaggtggtanggtcggaattcccgggatgacctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaaagaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaa

SEQ ID NO: 438990 - DNA, 7920 bp, Homo sapiens
  misc_feature (41)..(42): n is a, c, g, or t
gggggcctggacaccaccaagtctgtggtcataggtacggnngacacgatgtccactgggctcacgggggcagcgaatgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaaagaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaa

SEQ ID NO: 438991 - DNA, 6171 bp, Homo sapiens
gggcgaattcctcctcctcctaggcgaattcctcctcctcctgggcgaattcctcctcctcctgggcgaattcctcctcctcctccctccaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaa

SEQ ID NO: 438992 - DNA, 3467 bp, Homo sapiens
ctttgtaatgcttaccagttatgcaagtaaaatgaaaagggtggttctgtcagatcttaacccaaatccaaggtgaagcctggtttcctgcataggcgagaaggccccagggcccagaatccctcctcaccccttctacctccatccagggccccactctggggcaggcagtgctggctgcattcagctcagtggggggcagtttgactatgtcgcatccagcttcccatgccgtccatccctaggagtctgtctcaccatacaagggcgcagacaggccagcttgagggtgttcatcaacgcagcattgtttgaagagcagaagttagaatctattcattcgggggcctgactgcataaatacactgtggttgccgtccagcagagcatcatgcagccattaactgcactcacatgggaaaatgcccacaatggcttgttgtttaaaaaaaaaaaaagtgaaaaaatatttctgctgtgtgtggaattatgagaaatgtttacctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaa

SEQ ID NO: 438993 - DNA, 1784 bp, Homo sapiens
attgggggtaattagagagtagcagcagcatctctgaacatttctctggatttgcaacccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacacttttctgtcccaaccgttccctcacagcaaagcaacaatacagcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaa

SEQ ID NO: 438994 - DNA, 8063 bp, Homo sapiens
gcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaaagaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtggagcccatgtgaggcctgcatgcttattggacctgtctttgtgccccgttaatacttgtgattatccaacgttttcatggct

SEQ ID NO: 438995 - DNA, 7138 bp, Homo sapiens
gcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaaagaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccaggtaggagcctgggcctttcacttcccatggggctgcttccctcttgggtcaaaagggagatatgttcaccagtgattggcctcttcca

SEQ ID NO: 438996 - DNA, 419 bp, Homo sapiens
gctttatccttgttggcaagccccggcaagtcaagctgtctactgcgtagttggtactagcccgctagagggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaa

SEQ ID NO: 438997 - DNA, 229 bp, Homo sapiens
cccttcatcctcctggatttcttgctttgtcttcctccaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggtcagtggctttcttgcttcatcttgttggggacttggcctt

SEQ ID NO: 438998 - DNA, 3512 bp, Homo sapiens
tgagtaaatcgatacatcatacgcgcgctcctctggccgcccctccctccgacgcggggaccctggcgggcggcaggaggacatggccagcgacgccgtgcagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 438999 - DNA, 3466 bp, Homo sapiens
cctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439000 - DNA, 3626 bp, Homo sapiens
atgaggtgcctggaagggtttgtctccctcaaggcgtaaagcgctaggatttgaatgcagatccgcccagagcttgtctccaggggtcccgggaggcccaaaggcctccgccgctctcggcttgaacgcgtggaaccgttctcctcgggttcccgcgcgctccaatgggggacccctcggcagcgtgcggtcgtctcgggacccggaaagaggaaagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439001 - DNA, 3470 bp, Homo sapiens
ggctgtacggtccggaaggtctttggatcggaggcaataaccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439002 - DNA, 3212 bp, Homo sapiens
cctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439003 - DNA, 1997 bp, Homo sapiens
agaccttacggctaaggtacgaggcctgggtggctgagaagaaaatttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439004 - DNA, 1689 bp, Homo sapiens
  misc_feature (13)..(13): n is a, c, g, or t
  misc_feature (68)..(68): n is a, c, g, or t
  misc_feature (80)..(80): n is a, c, g, or t
  misc_feature (87)..(88): n is a, c, g, or t
  misc_feature (104)..(104): n is a, c, g, or t
  misc_feature (108)..(108): n is a, c, g, or t
  misc_feature (113)..(113): n is a, c, g, or t
  misc_feature (142)..(142): n is a, c, g, or t
ctccaccctcganctggtccccatcaagatcaacgtccgagctgctcgaaaccagaaacccagccccncctggcagcctntgagaannacttttacctcgaagntttnaagtnctgcggtgctgggccgggtcattttgggnagtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439005 - DNA, 1860 bp, Homo sapiens
cttgcagggcctcggaggctgctgtggttatgagggcatctctgactccccttactctggcctcctctctccgccacagagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgaggtggagggcagggaattgggagaccccccaggtccctggctggccgctaaaaccacccctgcccactgtggttccaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439006 - DNA, 2714 bp, Homo sapiens
cctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggcatgggaagcccatattgttccgcgcactccaccgtcactctgag

SEQ ID NO: 439007 - DNA, 3163 bp, Homo sapiens
cctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439008 - DNA, 1191 bp, Homo sapiens
  misc_feature (54)..(54): n is a, c, g, or t
ggatatcgtcgacccacgccgctcggatcgcagactttggcctctgcaaggagnggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439009 - DNA, 2307 bp, Homo sapiens
cctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttatttccccctgcccccccccttttgtgccccacgctggtcccggccgcacaccgaatttaagaaaactttttaacgaaggaggtttcacccgggggggggccccccccacaac

SEQ ID NO: 439010 - DNA, 2649 bp, Homo sapiens
cctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439011 - DNA, 1057 bp, Homo sapiens
ttacgaggcatatgtcgacgaggccgtcggtgtgctgcgtctgacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439012 - DNA, 1284 bp, Homo sapiens
cctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagctccccgtcacgcccggggcgcacgcgcgctcctctggccgccctccctccgcgcggggacccctggcgggcggcaggaggacatggccagcgacgccgtgcagagtgagcctcgcagctggtccctgcttgagcagctgggccctggcggggcagaccttggcggccccgggggtacagcaacacagctggaagcctggagcgggaaccggctgcggcgggaatccgcaagagcttgaagctgcaggagggtgctgcgaaccttatggaaggccacc

SEQ ID NO: 439013 - DNA, 1075 bp, Homo sapiens
cctggccaggcgaggcgggagccgagcaggccggagcgggccgcgcgccggggagggtcgcgccgcgcccgccccctccccgccacgcccggggcgcacgcgcgctcctctggccgcccctccctccgacgcggggaccctggcgggcggcaggaggacatggccagcgacgccgtgcagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggccagggaaatgcagatccacagaatgggctgtgggcagcctgagcgggactgggactgccgccacacccaagggggtgtgaaaaaacctggggccctcgggttagacgcgggggcttcccacaaaaacgtgacgggcagccggaaatgggcgaccacac

SEQ ID NO: 439014 - DNA, 227 bp, Homo sapiens
tgcggggattacaggcatgagccaccgtgcctggcctgcaaatgcatgttgttacatccacatgtgaacactctgccacagtcacctaggacctgcatggtgtggctagaccccaaccacctagccttcctctctcagactgtctctgcctccaggaccggaagctgctgctgacagcccagcagatgttgcaggacagtaagaccaagattgacatcatccgcatg

SEQ ID NO: 439015 - DNA, 3466 bp, Homo sapiens
gaattcccgcgcagagactccaggtcgcaggtcgacatggccagcgacgccgtgcagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439016 - DNA, 3589 bp, Homo sapiens
cctggccaggcgaggcgggagccgagcaggccggagcgggccgcgcgccggggagggtcgcgccgcgcccgccccctccccgccacgcccggggcgcacgcgcgctcctctggccgcccctccctccgacgcggggaccctggcgggcggcaggaggacatggccagcgacgccgtgcagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439017 - DNA, 2875 bp, Homo sapiens
gtcctagcctcgccagtgtcctagcctcgccagtggtcctagcctcgccagtgtcggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439018 - DNA, 2295 bp, Homo sapiens
actagtccacggttggctaacatggatcagacacttacaaagcaccaggtactgctctaaccactttgtaagtatcactgcatctcatactaaccctagtaccttatgatgtacgtactagtattattcaaagtttccaaatgaggaaagtgtggcccagaaggattaagaagcttgcccaaagactagtccacggttggctcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439019 - DNA, 3403 bp, Homo sapiens
cctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439020 - DNA, 3554 bp, Homo sapiens
cctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaagggtgaggacccccgacgtggggcgggcctggggaggggcagtggggcccaggaggggacagatcctgacacagtgctccttcctccaagctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439021 - DNA, 2717 bp, Homo sapiens
cctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatcttttattccgcctgcgtggtgctgggcctacagtttcttcacgaacacaagatcgtctacagggacctgaagttggacaatttgctcctggacaccgagggctacgtcaagatcgcagactttggcctctgcaaggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactcggggctgggaagcgctgttggcccgtcttccgcagcctaggggatcctcgac

SEQ ID NO: 439022 - DNA, 2994 bp, Homo sapiens
cctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctccttccagcccatcgagcctgagctcccccatccaggaatccactgctcccgagctgccttcggagacccaggagaccccaggccccgccctgtgcagccctctgaggaagtcacctctgaccctcgaagatttcaagttcctggcggtgctgggccggggtcattttgggaaggtgctcctctccgaattccggcccagtggggagctgttcgccatcaaggctctgaagaaaggggacattgtggcccgagacgaggtggagagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439023 - DNA, 1188 bp, Homo sapiens
caggctgttatatgaggatccccgcagactctgagcctcgttaaacggaggggatgggctatggggaccggaccagcacattctgtgggaccccggagttcctggcccctgaggtgctgacggacacgtcgtacacgcgagctgtggactggtggggactgggtgtgctgctctacgagatgctggttggcgagtccccattcccaggggatgatgaggaggaggtcttcgacagcatcgtcaacgacgaggttcgctacccccgcttcctgtcggccgaagccatcggcatcatgagaaggctgcttcggaggaacccagagcggaggctgggatctagcgagagagatgcagaagatgtgaagaaacagcccttcttcaggactctgggctgggaagccctgttggcccggcgcctgccaccgccctttgtgcccacgctgtccggccgcaccgacgtcagcaacttcgacgaggagttcaccggggaggcccccacactgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439024 - DNA, 2041 bp, Homo sapiens
cctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacagtggtggggcagacgtcttggaagccatgtggccccaatgcctgggaccagagcttcactctggagctggaaagggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtcaccttccgcaaccctgtcattgagaggattcctcggctccgacggcagaagaaaattttctccaagcagcaagggaaggcgttccagcgtgctaggcagatgaacatcgatgtcgccacgtgggtgcggctgctccggaggctcatccccaatgccacgggcacaggcacctttagccctggggcttctccaggatccgaggcccggaccacgggtgacatatcggtggagaagctgaacctcggcactgactcggacagctcacctcagaagagctcgcgggatcctcctaataaataagaaaggcccactgacacaaccccactttaccttctgtgagcttggcctgcttctgctgtctggcccgtaacctgtgttccaccactgaaagcccgtgactgttaaatccataccttcagacgacaagcacacgggagaggcagagtgagagggcaccatagccacttcccatacacttaggactttttcaaaacaagagaaaaaaaaaaaatcacagtcagttcttacacttccagggtctaaacaccactgggactcacatagatgacctgcagacaccata

SEQ ID NO: 439025 - DNA, 1923 bp, Homo sapiens
cctcagcccggacccaggatggcggaggccaataacccctcggagcaggagctggagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacgatggcccccagtcccctggtgcgggtggccccacctgctcggccaccaacctgagccgcgtggcgggcctggagaagcagttggccattgagctgaaggtgaagcagggggcggagaacatgatccagacctacagcaatggcagcaccaaggaccggaagctgctgctgacagcccagcagatgttgcaggacagtaagaccaagattgacatcatccgcatgcaactccgccgggcgctgcaggccggccagctggagaaccaggcagccccggatgacacccaagggagtcctgacctgggggctgtggagctgcgcatcgaagagctgcggcaccacttccgagtggagcacgcggtggccgagggtgccaagaacgtactgcgcctgctcagcgctgccaaggccccggaccgcaaggcagtcagcgaggcccaggagaaattgacagaatccaaccagaagctggggctgctgcgggaggctctggagcggagacttggggagctgcccgccgaccaccccaaggggcggctgctgcgagaagagctcgctgcggcctcctccgctgccttcagcacccgcctggccgggccctttcccgccacgcactacagcaccctgtgcaagcccgcgccgctcacagggaccctggaggtacgagtggtgggctgcagagacctcccagagaccatcccgtggaaccctaccccctcaatggggggacctgggaccccagacagccgcccccccttcctgagccgcccagcccggggcctttacagccgaagcggaagcctcagtggccggagcagcctcaaagcagaagccgagaacaccagtgaagtcagcactgtgcttaagctggataacacatgagcccgccccgcgacgcgcggcccctcacagccgcggagcaggcagccttcctggacttcgacttcgtggccgggggctgctagccccctcccctgcccctgcccctgcccctgcccgagagctcttagtttttaaaaaggcctttgggatttgccggaaaaaaaaaaaaaaaaaaaaaaaaaaaaaaaaaaaaatctggggggcactcaaaggcggggagggcgggaaaacacgggggaaccaaagggcccacagggcacacaaacgggtctctgggcccaagtttttgggacaaagggggaacaaccgcgcgggaaccccccataaggaggaggggcaacaaaactcgcggaaaacccaggagtaacccggataagacacacccgcgccacacaaacagaagacaaacgaaagaaaaacgagagaacaaaaaaatgtggagaccacaaagcactgggggccaggagacacacagatgaacaaactgtctgacaacacactcagcacactataaaccccacaaaaacaaaataaaacaaaatcataattctatctaaataactttctccactttttccaaatatccataccaaacacataaacacctaaaataacacacatcaaaacaatacaaacgaaaaaccggacaaaacacaactcaacacaaacacgcccaactacaca

SEQ ID NO: 439026 - DNA, 569 bp, Homo sapiens
ctcaacactgttattctctagcttatcttcttggtcagagtctactttcttcttttctgggaagatgcttgtaagggagtaaggagaggctttctagctggaagggaagggcaaaatgaatgattagtgtttggaaacaccacaatactctgggaattgaacgttttctaaatccctgattgtaatgctgatgagtagaaactgactctgtttgtcatgtttagttttcataaatgataacaacgcctaacacaatataagtatattttctttttcaatataaaatgtctttgattcttgtattatttctttacatgaatggagggttggcctaagaagtatgctgtttcataggctcttgtataagataaatgaaaaagcaaagaaaatgaataaaatctaatactagaaaagaatgaaaaaatatgattaagccagtcatatattttgtagaaatggccatatgaggcattgtacccctaccctgttacctcctctaccactttctcatggtttgtttgatttagcatccttgccttgcgttttcttgtgttagaatgaaaaaaaaa

SEQ ID NO: 439027 - DNA, 4315 bp, Homo sapiens
aggcgcagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcactgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactg

SEQ ID NO: 439028 - DNA, 559 bp, Homo sapiens
cctacccatctttttttgtggtcgtgatgtctgtgaattggtggtgcagatgtgtggtgacttttgatgaatgactttcttcttctcccagccctcaaggaaaccagcaaatcaaaagggtctcctgcttttttttttctttttgtcctccagcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacggtgagtgattttagctttttttcctggccctcctaccacccacacatacactttctcgacacataaaggagatatgtaaactgaggtcccgggtattgctacagcaaagacggtggtcctgattcccacgatactgccagattatacttacgtcatcagagtggctctttgagatccagatgatgtgagttatggtgaagtcacctactgctactcatactgcagataaattagtagtagtgacaacggtagcctgccttc

SEQ ID NO: 439029 - DNA, 4818 bp, Homo sapiens
ggaaccaaagtaagagtttaaagtgcaacagaagagagtctgctgaactttagacatgagggatccagggaggaagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactg

SEQ ID NO: 439030 - DNA, 2704 bp, Homo sapiens
  misc_feature (4)..(4): n is a, c, g, or t
gganccccgaaggcgtggtctgggtcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactg

SEQ ID NO: 439031 - DNA, 4808 bp, Homo sapiens
aggcgcagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactg

SEQ ID NO: 439032 - DNA, 2196 bp, Homo sapiens
ggacgcgtgggtccggacgcgtgggtcgatccacgcgtgccgcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactg

SEQ ID NO: 439033 - DNA, 2098 bp, Homo sapiens
  misc_feature (1)..(1): n is a, c, g, or t
ngacaaaacaaaatagaaaaaaaaaaaaataacggctaagtcgagcccgggatgaatcggacgaggctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactg

SEQ ID NO: 439034 - DNA, 3747 bp, Homo sapiens
  misc_feature (3604)..(3604): n is a, c, g, or t
  misc_feature (3609)..(3609): n is a, c, g, or t
  misc_feature (3645)..(3645): n is a, c, g, or t
aggcgcagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagatttnttttntttctttttttttatttgtttttttggggttctcangtgttggagagacattagtaaagccacatccttgcctagcataaaactcctgtttcttgattgttgtcctacagtgcctccattgctgcattttttaaaatc

SEQ ID NO: 439035 - DNA, 3423 bp, Homo sapiens
aggcgcagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactg

SEQ ID NO: 439036 - DNA, 2324 bp, Homo sapiens
aggcgcagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaataaatcagccctggagtgccccagaattccaagggcctgggtatgggccagtgtagctttggaaccaatcacctccaagacactacagcttctcaatgacctgtccattgggtacagtagcgtaaggaagctagtgaagcttagtgcggtacagttcatgctgaacaatcacacggtgagtgattttagctttttttcctggccctcctaccacccacacatacactttctcgacacataaaggagatatgtaaactgaggtcccgggtattgctacagcaaagacggtggtcctgattcccacgatactgccagattatacttacgtcatcagagtggctctttgagatccagatgatgtgagttatggtgaagtcacctactgctactcatactgcagataaattagtagtagtgacaacggtagcctgccttc

SEQ ID NO: 439037 - DNA, 446 bp, Homo sapiens
atggtgttaaacgaatactggaaaacccacaggtaagtttatctgagaatttacatatgtataggattagtgtatggccagctgttatgagtcagaaggaaatccatcccaaggcccagtaaacaattcagtctgttcttcagggaagactgaagtgaatctctatttgtaggccaattctgagattatttgcccaaaagaggagcttatatcctcccgcttcagaaatgtaggagttacaggaaagaatcacttcgctataaggaaataaggaagaagctagtcatttttccccccaagaagttaagactctaacatctccgggcacagaggctcacgcctgtaatcccaacagtttgggaggccaaggtgggcagatcacttgaggtcaggagctcaagaccagcctggccaacatagtgaaaccctgtctctactaaaactac

SEQ ID NO: 439038 - DNA, 183 bp, Homo sapiens
tgttgcttcagatatcctaaagaaggatattgtaggaggtggaacgtttctggtgaaagtaactgtacagtctttttaatcgttgtgtttgggttctgccctgcatttaggtattatcctgcttggtacagatcgcttcagtcagaagatccctgtttaacaatgcagagagggccaagtttc

SEQ ID NO: 439039 - DNA, 360 bp, Homo sapiens
gataagatgacccttttaaagtgctttacaatttaaaaattcttgatattcttagtaggatgaagccatattatcccacaagtgcttgcctgaatttcttttttaagggtccaattttagtagacattccattcctccttagagaagaacattcttcaaccctgcagatgacggagggctaatctgccttcccctgcttctctaaccttctgttccactccttgccccacagtatttttctgacctaagaaacagtattgtgaacagccagccaccggagaagcagcaggccatgcacctgtgttttgagaacctgatggaaggcatcgagcgaaatcttcttacgaaaaacagagacag

SEQ ID NO: 439040 - DNA, 458 bp, Homo sapiens
  misc_feature (2)..(2): n is a, c, g, or t
  misc_feature (25)..(26): n is a, c, g, or t
anttcggcacagagaatttgatganncatgtgtggaatcctcatcagattgttacagttttgtcttttcttctattttaacacatttttgccttctactacagcgaactctagttggcctagtaagagacctgagagggatcgctttcgctttcaatgccaagaccagcttcatgatgctctttgaatggatgtatcctaactcaaactaggagcacactacagcctgccttaactggagtgtgattgggtgatagggtccagagacggtgtagggggaagggagggtagtgaggcagagaagatgaagagttagccagaaggcctgcatgtgtcctggaagccaccttatgacagacataaggttgtctgagattagaacatgaatgaagtagtctcccagtttctcttttggatctcaaatataaatgcctgtggaaccatataccactgtagaac

SEQ ID NO: 439041 - DNA, 4862 bp, Homo sapiens
aggcgcagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactg

SEQ ID NO: 439042 - DNA, 2969 bp, Homo sapiens
  misc_feature (62)..(62): n is a, c, g, or t
  misc_feature (74)..(74): n is a, c, g, or t
  misc_feature (76)..(76): n is a, c, g, or t
tagaggatcctgaaaagtgcactcttctatatctacacctccaagacactacagcttctcantgacctctccantnggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactg

SEQ ID NO: 439043 - DNA, 4737 bp, Homo sapiens
aggcgcagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagccatatcagggagatcctctagacca

SEQ ID NO: 439044 - DNA, 4808 bp, Homo sapiens
aggcgcagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaattgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactg

SEQ ID NO: 439045 - DNA, 2051 bp, Homo sapiens
cattggtaagtgaagttcaaaccaattttaagaacaagaaaggaaatgaatatcttagaagaaaaggtaaccttgaaatagaagactcagatgaagcttcacaaactatttgtctgatttaccctatacagaaaaggccttcagcctaatatactcctgtatttggaatctgtcgttttatcttgggtagcaatacattaggtcactgcctgaaattctccattccattttcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactg

SEQ ID NO: 439046 - DNA, 2295 bp, Homo sapiens
aggcgcagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacggtgagtgattttagctttttttcctggccctcctaccacccacacatacactttctcgacacataaaggagatatgtaaactgaggtcccgggtattgctacagcaaagacggtggtcctgattcccacgatactgccagattatacttacgtcatcagagtggctctttgagatccagatgatgtgagttatggtgaagtcacctactgctactcatactgcagataaattagtagtagtgacaacggtagcctgccttc

SEQ ID NO: 439047 - DNA, 1198 bp, Homo sapiens
aggcgcagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagtaagtgctacagccttcctcattgaagcagacaccacccatcctttaaccaagcacagaaaaatagcctcttcttttcgcgattcatcattatttgatatcttcacactttcctgcaatttactaaaacaggtgagcatgtagtttgggtcatatttcccagtttcttttgaaagaatgagaatggatgggaacttgttaaatgtcagcttttaactgatcccacgagagtttatgcatctgtttaatcatcatctcttatataagactcatagaggcgttgaagaaactggtcagagtgaccactgaggttggagaaatgattgtcacttccctgtttaagctcaattcccctaggtaaagagcagtaagtgagcatttatcccatactcctatcttaaagggatctagtttacctaactcagagtttgaagttgtgttgttattgtttttataaccacataaaatctttctatatggtgcgaaagcatgttagttttatggtgtttggattcttagtgctctgaaagtaggttcagactatgttgttagcatacagaaaccaggctggttcccctgtcccccgctgagttaaaagcagcac

SEQ ID NO: 439048 - DNA, 2226 bp, Homo sapiens
ctctgacttcttttcttggctaagccgcgtttgtactgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaattt

SEQ ID NO: 439049 - DNA, 815 bp, Homo sapiens
  misc_feature (769)..(769): n is a, c, g, or t
  misc_feature (815)..(815): n is a, c, g, or t
ctctgacttcttttcttggctaagccgcgtttgtactgtgtcttaccatgcctgaaccggcaaaatccgctccggcccctaaaaagggctccaagaaagccgtcaccaaagcccagaagaaagacggcaagaagcgcaagcgcagccgcaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgattgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaaccatcagtcttcaaattttggacccatgaagggaggaaattttggaggcagaagctctggcccctatggcggtggangccaatctttgcaaaaccacgaaaccaagtggcttttgcggttccn

SEQ ID NO: 439050 - DNA, 2172 bp, Homo sapiens
ctctgacttcttttcttggctaagccgcgtttgtactgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaattgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaattt

SEQ ID NO: 439051 - DNA, 1933 bp, Homo sapiens
aacggatattcatagccgtccctgtttgttatttcgatcggggcgggcttcgcttagttacgtgggcgcgggctgtacaatcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaattt

SEQ ID NO: 439052 - DNA, 1933 bp, Homo sapiens
  misc_feature (122)..(122): n is a, c, g, or t
  misc_feature (129)..(129): n is a, c, g, or t
ccgaaaaggcaagagagatatgtatagtcgtactggttattcgtacgggcggcttgcttatttttcagtgctgcgatacacggtcgaggcacagcgtcacaagttacacgcgtaaaggttcntccccanatgtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaattt

SEQ ID NO: 439053 - DNA, 1388 bp, Homo sapiens
ggtgcctggtacggtcccgaatttttgggatcaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaattt

SEQ ID NO: 439054 - DNA, 653 bp, Homo sapiens
tcgagtcggtaccggtcccatgcgcagtctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaattt

SEQ ID NO: 439055 - DNA, 608 bp, Homo sapiens
  misc_feature (12)..(12): n is a, c, g, or t
gaggatccctgnccgagatgcatacgggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaattt

SEQ ID NO: 439056 - DNA, 2227 bp, Homo sapiens
tgctaggtacgaggccggggtgttaatcggccgaggctgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaattt

SEQ ID NO: 439057 - DNA, 2346 bp, Homo sapiens
ctctgacttcttttcttggctaagccgcgtttgtactgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaatttgagatcatgactccaggggggccggacccaatggcaaagggatggtacaatcagggccgcgttaaagtggcttggaacctgggtcccattatgcgcggcctttcacgggctatatcgcgt

SEQ ID NO: 439058 - DNA, 1061 bp, Homo sapiens
gtgatttgctggaattgtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagtcttgctgtctgtgaggaatcttctgccagaccaggaggtgaaagtcttcaggatcagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaacaaaaaaaaaatt

SEQ ID NO: 439059 - DNA, 2435 bp, Homo sapiens
agcggagagaagaagcaggcagcttgagacaggtggagctggatcaagctgtgaacgtgatttgctggaagctggtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagtcttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaacaaaaaaaaaatt

SEQ ID NO: 439060 - DNA, 2413 bp, Homo sapiens
gaacagattttaactctgaaaagccatttccagtgtctatagactattgtgagcctggagaagtagcatttagttgggatagctccactagagctgcctgccaaagacttccttccacaggatcttgtcgcaccagcaactgacaggagcttgggagctcgggagcttgggagagggcttatgtttttaataatgtagctgtcagttcgaagcctggaaatgttgaccctcaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagtcttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaacaaaaaaaaaatt

SEQ ID NO: 439061 - DNA, 2378 bp, Homo sapiens
agcggagagaagaagcaggcagcttgagacaggtggagctggatcaagctgtgaacgtgatttgctggaagctggtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagtcttgctgtctgtgaggaatcttctgccagaccaggaggtgaaagtcttcaggatcagactctctgaaaactgcaaatggaaaggaattcaaaagaatttagattaaaagttaaataaacaaatataatcccaagtatcctctctccttccttgttggagatgtcttacctctcagctccccaaaatgcacttgcctataagaaacacaattgctggttcatatgaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaacaaaaaaaaaatt

SEQ ID NO: 439062 - DNA, 2599 bp, Homo sapiens
tatgtgctattagatttgcaaattgctgatctcccagtgactttccctcttagatcccagttgagtatggttaccttgagaactgtggtattagccatgttagagcatgctccactggggagttctgtgcagtctatttttaatgctatttaatgaaggagcgagcgcctcactcagcaataaaagaagcatgagggaagacagagcagtgcatggttatggatactggacaaggatatttggaaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagtcttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaacaaaaaaaaaatt

SEQ ID NO: 439063 - DNA, 691 bp, Homo sapiens
agcggagagaagaagcaggcagcttgagacaggtggagctggatcaagctgtgaacgtgatttgctggaagctggtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagtcttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatg

SEQ ID NO: 439064 - DNA, 682 bp, Homo sapiens
agaagtagcatttagttgggatagctccactagagctgcctgccaaagacttccttccacaggatcttgtcgcaccagcaactgacaggagcttgggagctcgggagcttgggagagggcttatgtttttaataatgtagctgtcagttcgaagcctggaaatgttgaccctcaaaggtttattgccaaaattagataccatatttatgctgaattattaccttttcaatagttttttttgaccttgcagactactgtattctttatacctagggaagcatgtctatgtttggaacctgcaaataatttttcagtcatcttagagatgctgcagaacatcaatgccacatcttgagtcagaagtcgagggtcatttgttcaaaagttggagaaatatcctcttttgttgcttcttctactctgtagtggagaatggggaactggtagttgtgtgggagttatgtgtctctaagatttgtcgacccattttgatggcaaggtgtattcacaagtgtgtgtaaagggggtgtggatgggacaactgcatctgcctcttgtgcatgccttgggtacttgatttcatcttgttttttcccccttttgtataaaattctcaaaattgctcatttggatttgaatatgaaaggagaaatgaaatctctaaagaatgatagtaaatacc

SEQ ID NO: 439065 - DNA, 338 bp, Homo sapiens
atgatttggcagtctgagaatgcttcctgtttgttttctttattttcctttccttcccttttctttcccccctcctagtcaggagcaggaaaaggtaaactgactcgcagtcttgctgtctgtgaggaatcttctgccagaccaggaggtgaaagtcttcaggatcaggtatatccccttgccattatcattaattgcatgaatgggatccacctttgtgtgcatgactcttaatttggtgttaaacagtgttttgggggagaaaaatataattgaagaaaataattcattttttggctttatcccctgcttatgcaacattctaaaatagtttaatg

SEQ ID NO: 439066 - DNA, 855 bp, Homo sapiens
tatgtgctattagatttgcaaattgctgatctcccagtgactttccctcttagatcccagttgagtatggttaccttgagaactgtggtattagccatgttagagcatgctccactggggagttctgtgcagtctatttttaatgctatttaatgaaggagcgagcgcctcactcagcaataaaagaagcatgagggaagacagagcagtgcatggttatggatactggacaaggatatttggaaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagtcttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatg

SEQ ID NO: 439067 - DNA, 3175 bp, Homo sapiens
  misc_feature (1073)..(1073): n is a, c, g, or t
  misc_feature (1807)..(1807): n is a, c, g, or t
  misc_feature (2362)..(2362): n is a, c, g, or t
agattttgaaaattaaatattactgaagatttcgacttccactgttaaatgtacaagatacatgaaatattaaagaaaatgtgtaactttttgtgtaaatacatcttgtcttgttttcattcaaaaacatttcacttttggggttgcgtgtcagatttggcagtataaattctggctatattttttgttgttagatttatttggctgttaagtattgcgatatgactaaacatactgtatacctgatgatcatctgtaaagttagagtatatctttttgctttctttggagttagtgttattccaggatattttacttaatctaaaagttaatttatgttgctcatatattactcaagtatttaaatttagagagaatgccgctctgtttaaagcaatgtgtaaagatgagtttttttaagcatggaatttagggttggggtacaatttgtttctattaagcaagtaccagtttaccaatacatgagtaactgaagtgtaactgttaaatgcttgtatactagtttttctttctgattgtcagtgatttataagctataaatgaccaaggtcctcagactgcttttagcatctgcaacttaaaaaaatgggagttagaaaaagaacaaatgctaaatagagtaacagttaaatgtatgtgtacactcttcccaaatgccaagagtgcagcggtggggtgagattcagatattcatttatttctaagtctgtagttaacatttatgttccctactccctacgtaagccagactttggcaacagtgatagttgattccaggcttatttgacttaaagtcactgaagtggaaactaagaagtggcagttagtgttttacccagcatttctgccttctctcttttcttcatgtgtttttgtctctagcctatgtgtatttgtgtagaataatgtgggatacctgaataatagatttaaaaggaccaagtggtaaaattgggcccaagctgaagtacaggcaaacttgatgtttgaaagataagttttgagaaatgtcattgtattttggagtaaaagaggctatcttagtaataagnaataaacttccataacactaggttagaccacccaataaatctagaaatcagcttttaaaaatattgtctgaagtctaacaaaagttttcacctctaatgtgttctttaagaaatttaaggaacttagccttggattcctgaatagaaaggtaagaattctatcattctggagttgatgaaaacataaattttcaggatgtgaaatgaacagtgatttataaaatggaaatcaaattgtacattagcagagttcttaagctttttgaattgaaggagacctaataattgtgtctttttggttatttagtgacaaacgtggctttcaaactatgcttaaaaagttccggctggacacggtggctcacacctataatcctagcacttggggaggctgaggcagatggattacctgaggtcaggagttcgagaccaacctggccgacatggtgaaacgctgtctctactaaaaatataaaaaattagccgggtgcagtggcgtgcacctgtaatcccagctactctggaggctgaggcaggagaatcacctgaacctgggaggtggaggtttcagtgagctgagatcctgccactgcactccagcctgggcgcaagaccaagacttaaacgcaaaaaaaaaaaaaaaaaaaaaaaaaaagtttcataatacagcatggtctggtagtttgcaaaatggtgtgcttttggggagatacactagcaatttttttaaaaantggaacagtgtgataggaagcctgctggatgatttcttaaatattctaaaatgtaagtcaaatatgttttaataacaaagacttaaatggcttttctccctagagactgaaactagtattcattgtgttcagaacttaattgggcttgaactgagatttaaatctaataaacaagttaataaatgtgtatgttttgttgtgggtttggtagtgatctgtggttctatagggtttaataggaattgcttttgatttgtttctggctttagaatgtgaggcaaattttacattcttggttctattaagattttcttaggcatgctaacatgccaacaaaaagccatgtaagtattgtataaaaagattcacattgttaatttagccattttgaaattcagatgagtgagcaagttgataatggcctcatctctgacctgagaaaaaacaactttgacccttgttcttaaaatgctttaaccttgaagttgcttgagacttaagaggtcatgttgctttaggtttaataaatagccttaactatttggaggggaaaanatgggtcaactttttttttttttttggcgtttgcatgtacaactttctatttttagcctatatttggaaagaaagcacttaacattttaggaattctttttaaagctgcttgcaaagtgttggtgattttactgaaaacttttgagatcttcattttacaggcagacctgtctaactacaagccagacttgggttttctcctgtagtttgaagacacactgactcctgacaaaatgcagcctgcaacttcctggagaacaactcagtgtcacattaaagtttattatgtatttaatgatacactgtttaattgacagttttgcatagtttgtctaactttagagaattaagagcctctcaactgagcagtaaaggtaaggagagctcaatctgcacagagccagtttttagtgtttgatggaaataagatcatcatgcccacttgagacttcagattattctttagcttagtggttgtatgagttacatcttattaaagtcgaaattaatgtagttttctgccttgataacatttcatatgtggtattagttttaaagggtcattaggaaaatgcacatattccatgaattttaagacccatagaaaagttgaagaatgcttaattttcttatccagtaatgtaaacacagagacagaacattgagatgtgcctagttctgtatttacagtttggtctggctgtttgagttctagcgcatttaatgttaataaataaaatactgcattttaaagctgttaagaaattgtccagaacgagaatattgaaataaaaacttcaaggttataatcgc

SEQ ID NO: 439068 - DNA, 3120 bp, Homo sapiens
  misc_feature (1018)..(1018): n is a, c, g, or t
  misc_feature (1752)..(1752): n is a, c, g, or t
  misc_feature (2307)..(2307): n is a, c, g, or t
agattttgaaaattaaatattactgaagatttcgacttccactgttaaatgtacaagatacatgaaatattaaagaaaatgtgtaactttttgtgtaaatacatcttgtcttgttttcattcaaaaacatttcacttttggggttgcgtgtcagatttggcagtataaattctggctatattttttgttgttagatttatttggctgttaagtattgcgatatgactaaacatactgtatacctgatgatcatctgtaaagttagagtatatctttttgctttctttggagttagtgttattccaggatattttacttaatctaaaagttaatttatgttgctcatatattactcaagtatttaaatttagagagaatgccgctctgtttaaagcaatgtgtaaagatgagtttttttaagcatggaatttagggttggggtacaatttgtttctattaagcaagtaccagtttaccaatacatgagtaactgaagtgtaactgttaaatgcttgtatactagtttttctttctgattgtcagtgatttataagctataaatgaccaaggtcctcagactgcttttagcatctgcaacttaaaaaaatgggagttagaaatgccaagagtgcagcggtggggtgagattcagatattcatttatttctaagtctgtagttaacatttatgttccctactccctacgtaagccagactttggcaacagtgatagttgattccaggcttatttgacttaaagtcactgaagtggaaactaagaagtggcagttagtgttttacccagcatttctgccttctctcttttcttcatgtgtttttgtctctagcctatgtgtatttgtgtagaataatgtgggatacctgaataatagatttaaaaggaccaagtggtaaaattgggcccaagctgaagtacaggcaaacttgatgtttgaaagataagttttgagaaatgtcattgtattttggagtaaaagaggctatcttagtaataagnaataaacttccataacactaggttagaccacccaataaatctagaaatcagcttttaaaaatattgtctgaagtctaacaaaagttttcacctctaatgtgttctttaagaaatttaaggaacttagccttggattcctgaatagaaaggtaagaattctatcattctggagttgatgaaaacataaattttcaggatgtgaaatgaacagtgatttataaaatggaaatcaaattgtacattagcagagttcttaagctttttgaattgaaggagacctaataattgtgtctttttggttatttagtgacaaacgtggctttcaaactatgcttaaaaagttccggctggacacggtggctcacacctataatcctagcacttggggaggctgaggcagatggattacctgaggtcaggagttcgagaccaacctggccgacatggtgaaacgctgtctctactaaaaatataaaaaattagccgggtgcagtggcgtgcacctgtaatcccagctactctggaggctgaggcaggagaatcacctgaacctgggaggtggaggtttcagtgagctgagatcctgccactgcactccagcctgggcgcaagaccaagacttaaacgcaaaaaaaaaaaaaaaaaaaaaaaaaaagtttcataatacagcatggtctggtagtttgcaaaatggtgtgcttttggggagatacactagcaatttttttaaaaantggaacagtgtgataggaagcctgctggatgatttcttaaatattctaaaatgtaagtcaaatatgttttaataacaaagacttaaatggcttttctccctagagactgaaactagtattcattgtgttcagaacttaattgggcttgaactgagatttaaatctaataaacaagttaataaatgtgtatgttttgttgtgggtttggtagtgatctgtggttctatagggtttaataggaattgcttttgatttgtttctggctttagaatgtgaggcaaattttacattcttggttctattaagattttcttaggcatgctaacatgccaacaaaaagccatgtaagtattgtataaaaagattcacattgttaatttagccattttgaaattcagatgagtgagcaagttgataatggcctcatctctgacctgagaaaaaacaactttgacccttgttcttaaaatgctttaaccttgaagttgcttgagacttaagaggtcatgttgctttaggtttaataaatagccttaactatttggaggggaaaanatgggtcaactttttttttttttttggcgtttgcatgtacaactttctatttttagcctatatttggaaagaaagcacttaacattttaggaattctttttaaagctgcttgcaaagtgttggtgattttactgaaaacttttgagatcttcattttacaggcagacctgtctaactacaagccagacttgggttttctcctgtagtttgaagacacactgactcctgacaaaatgcagcctgcaacttcctggagaacaactcagtgtcacattaaagtttattatgtatttaatgatacactgtttaattgacagttttgcatagtttgtctaactttagagaattaagagcctctcaactgagcagtaaaggtaaggagagctcaatctgcacagagccagtttttagtgtttgatggaaataagatcatcatgcccacttgagacttcagattattctttagcttagtggttgtatgagttacatcttattaaagtcgaaattaatgtagttttctgccttgataacatttcatatgtggtattagttttaaagggtcattaggaaaatgcacatattccatgaattttaagacccatagaaaagttgaagaatgcttaattttcttatccagtaatgtaaacacagagacagaacattgagatgtgcctagttctgtatttacagtttggtctggctgtttgagttctagcgcatttaatgttaataaataaaatactgcattttaaagctgttaagaaattgtccagaacgagaatattgaaataaaaacttcaaggttataatcgc

SEQ ID NO: 439069 - DNA, 941 bp, Homo sapiens
tccgcgaagctctcctcgcggggcgggccggccggccgcacccccggcctggggcctccggtcgtagtaaagcgcaggcgggcggggaggcgggagcaggagcccgcggccggccagccgaagatggtggcggctactcctcctgtcatacacgtggacctaactgcaccagtagcttttctgagaatacttgctgaaaaggaagttttctggaatggtatttgctaagtggaagccagaagaggaggaaaatgttttgccacgtggatgtgaagatttcctctaaaaggcagacctgtctaactacaagccagacttgggttttctcctgtagtttgaagacacactgactcctgacaaaatgcagcctgcaacttcctggagaacaactcagtgtcacattaaagtttattatgtatttaatgatacactgtttaattgacagttttgcatagtttgtctaactttagagaattaagagcctctcaactgagcagtaaaggtaaggagagctcaatctgcacagagccagtttttagtgtttgatggaaataagatcatcatgcccacttgagacttcagattattctttagcttagtggttgtatgagttacatcttattaaagtcgaaattaatgtagttttctgccttgataacatttcatatgtggtattagttttaaagggtcattaggaaaatgcacatattccatgaattttaagacccatagaaaagttgaagaatgcttaattttcttatccagtaatgtaaacacagagacagaacattgagatgtgcctagttctgtatttacagtttggtctggctgtttgagttctagcgcatttaatgttaataaataaaatactgcattttaaagctgttaagaaattgtccagaacgagaatattgaaataaaaacttcaaggttataatcgc

SEQ ID NO: 439070 - DNA, 678 bp, Homo sapiens
gcaaagatgagacccactaccagagaggttcgcactttttactgaatcactgccatgaatgatgttcctgccaacctgaatgcaaaagtccccacgaatggtgcctggcttagaatctgctggattggtctccccaagcatcactcggcctgtcttcacgacgttcagcccctcccagaccatggccacgaccggccctgagttcatgtacttcaccagcccagggaagaatgggcggtccttcaggtcaatgtagtgctgcttcaggtgttcttcagaggccgggaggaacttcatggccacgaggcggaaccccttctgctcgaagcgcttgatgatcttgcccaccaggccgcactgcatgctgtccggcctgatggtgatgaagacacagcctcactctgtcctccagtctggagtatagtggcacactgcattcttcacctcctgggctcaagtgatcctcctacctcagtctcctgagcagctgggactacaggcgcccaccaccatgcccgactaacttttttcgtatttttttagagatggggtttcaccatgttgcccaggttggtctggaactcctgggctcaagcagtccaccttccctgacctcccaaagtgttgggattacaggcgtgagccactgcacccagccttgtataagtaccttttttt

SEQ ID NO: 439071 - DNA, 768 bp, Homo sapiens
tagagacggggtttcaccgtgttagccaggatggtcttgatctgacctcctgatccacctgcctcagcctcccaaagtgctgggattacaggcatgagccaccacgaccggccagagatttgcactttttactgaatcactgccatgaatgatgttcctgccaacctgaatgcaaaagtccccacgaatggtgcctggcttagaatctgctggattggtctccccaagcatcactcggcctgtcttcacgacgttcagcccctcccagaccatggccacgaccggccctgagttcatgtacttcaccagcccagggaagaatgggcggtccttcaggtcaatgtagtgctgcttcaggtgttcttcagaggccgggaggaacttcatggccacgaggcggaaccccttctgctcgaagcgcttgatgatcttgcccaccaggccgcactgcatgctgtccggcctgatggtgatgaagacacagcctcactctgtcctccagtctggagtatagtggcacactgcattcttcacctcctgggctcaagtgatcctcctacctcagtctcctgagcagctgggactacaggcgcccaccaccatgcccgactaacttttttcgtatttttttagagatggggtttcaccatgttgcccaggttggtctggaactcctgggctcaagcagtccaccttccctgacctcccaaagtgttgggattacaggcgtgagccactgcacccagccttgtataagtaccttttttt

SEQ ID NO: 439072 - DNA, 2421 bp, Homo sapiens
cttccacaggaggtctacacgctttcgcttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439073 - DNA, 3249 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccagtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439074 - DNA, 2400 bp, Homo sapiens
  misc_feature (30)..(30): n is a, c, g, or t
tgattattgcatagtacgatggctggtgtnaataggcgaggtgaaaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439075 - DNA, 2385 bp, Homo sapiens
gggctggtactggtcccgggggtgtagggataccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439076 - DNA, 3431 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtgtggtcttcgtgggcgtggggcgtcgtgtgggcggggtggggtggtggtgggcgggggggtggcggtggcggtggtggtggggtgggga

SEQ ID NO: 439077 - DNA, 3362 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtaaaattagaaaaaaaaaaaa

SEQ ID NO: 439078 - DNA, 3366 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttagtcattgtgcttcttctgtttctaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439079 - DNA, 2474 bp, Homo sapiens
aggctggtctcgaattaccgacttcagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439080 - DNA, 2794 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgtgcttgtccgtttcctgtcagagttgatcccaggtttcctcctggacctgtcccatggtccctccacaggagtgtgagcacggaggaggcggaattcggggtaccg

SEQ ID NO: 439081 - DNA, 3275 bp, Homo sapiens
  misc_feature (1501)..(1501): n is a, c, g, or t
  misc_feature (1508)..(1508): n is a, c, g, or t
  misc_feature (1512)..(1512): n is a, c, g, or t
  misc_feature (1533)..(1533): n is a, c, g, or t
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggagctgagtgtgnaagcccnaccnttgcctgactctgtggtcatngcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439082 - DNA, 1622 bp, Homo sapiens
aaatcaaaggagttcaacatagtatctacctgattggaaaaaatgcaggggcagtttctttggaacaggctctgttgcatttggtgagcaacttaacttttggaaacacaggggcttacaccagtactttctccagtgacactattgctgtctcctctggtaacaatctttgtgtttcaggtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439083 - DNA, 1488 bp, Homo sapiens
tttctcctgtgttttgatcattttatttttactgccaaaggggatctgagtcatttctctggtatttgtaacgttgtgctccttgccctaattaggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439084 - DNA, 2445 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439085 - DNA, 1645 bp, Homo sapiens
  misc_feature (1586)..(1586): n is a, c, g, or t
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgctatgaatgtatttngggagcattctatgcacttgcattcactctcctacttacaggactcaacatactaatca

SEQ ID NO: 439086 - DNA, 1809 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccagtagatgacattaatgctgataagaatatctcttctgcacagattgttggtgagtagtatcaatcagaaacctgcagag

SEQ ID NO: 439087 - DNA, 483 bp, Homo sapiens
aaaacacttttcatataggtttactgaatatctttgggatctgttatagtcatactagtagttttttccacaaatgaataaaccaccaattattaccaggcagaacaacctttgtagataagatggtcattggtagtaagaaagtctcgttagagttttcccttgtaaacactgaagcacttgattcaataaagaatagcctttggctctagatctttaaaaatctggaatcctgaccacatgtggtccttttgggcatttttaaggatcttgaatatttatatatatttagtatgagaatataaatgtatttctttctcccttcccatacccaaaccttcgagattgcaaactggaggcagtgtctctgatgttgcctttctcctcttacagtcagatttcaatggactgccaatggggacttatcaggcctttcccaatattcatccacctcagataccagcaactcccccatcgtatgaa

SEQ ID NO: 439088 - DNA, 460 bp, Homo sapiens
ttctgccctttgtgacttttagactgagtaccttttttgcagagaaagggacatactctgttgttgtggcattaggtcacctgactcttgagttggaaatgtcaagccacatgagctatattttctacctagacagagtagcaaattctacagtagaggggatgggattagatttgctaaaggagaggagctaggatatagtagaaacacccagttcttcctgttggggggagattggcctgtaggccagatgcaagtgctctactgctgtgagatcggagtgggatttgtgtcttagcggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttg

SEQ ID NO: 439089 - DNA, 3342 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439090 - DNA, 3288 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagacaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439091 - DNA, 2385 bp, Homo sapiens
tcagtggggctgggtggtcgatcggccgaggaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439092 - DNA, 3363 bp, Homo sapiens
  misc_feature (3344)..(3344): n is a, c, g, or t
  misc_feature (3348)..(3348): n is a, c, g, or t
  misc_feature (3350)..(3350): n is a, c, g, or t
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtanaaananaacaaacaaaagg

SEQ ID NO: 439093 - DNA, 3207 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccaacacggtgcgttggcccaacggtgcgttggcccaa

SEQ ID NO: 439094 - DNA, 2352 bp, Homo sapiens
gccgggtgttaattcggcgaggcgtcacggaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439095 - DNA, 3290 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatgatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439096 - DNA, 2590 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacgagcggctcctcgtgtggcgcgtggggggggaggaggacagaggctgcggtttgactttgttaatttttcttttgttatattgtatttgctagtctctgactttcctcaaaacgaaggtggaatttactacgtgtgtgtcaggatctggtgttttgaattggtgcctgcctatagagatatattcacagttcaaaagtcaggtgctgagagaatggtttaaagacaaattcaatgaaggtactattgttgtcgatatagttgttgatgagttcgtttggttttcgtgatattttcccgcaactgagcctgtcgaagagcacccaaa

SEQ ID NO: 439097 - DNA, 2061 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439098 - DNA, 1400 bp, Homo sapiens
tttctgtagcctaggctggagtgctgtgacgtgatcacggtttactgcagcagcgaccttctgggctcaagcgatcttcctgcctcagcctcccgagtagctgagaccacaagtgctcactgctgctcccctaatttttaacttttttttttttttttttgtagcgatgcggtttcactatggtgtccaggctggtctgcaactcccgggctcaagcgatcctcccgccccgcctctcaaagtgctgggaaggtcccttccaggcttaagcagcgataatggttttcaagttaaaaacaaaggtaaccaaggaaaaagttttctctgaataccgagataaattagggaaatcgccagagactgtggtgctgaggaaacactactgaattataccacacagaccggagcgatgctggtccaaagggcaaccggacggcttaaaagcggggcgggggaacgcttagagcccgtagagggacacggaggcgctgggtgaagagtcagggatacgcaggcttcgaaaccccctcggccgctccacccagggggaaagtccagcgaaaggcggcagcagatcttagggagcaactcccggcgtcagagaggcggtactggcagccggttatggaagaatccggaaccaaggcactgggcgcggtgaggccgtgggcgcagagtccgagaatcaacagctgtggctggcctccccgcgcccagagcgaaattaagggcatgcccccagcagctgactcagtcggcgtggcgcttcccccaacgtctgccgtgcccccgccgcgggaagtagtccccggccgcgccgactccaaaggaaaccgagggagggtgccccgagtcagcgcgtgggtcccggcagcggcgatcgcgcagccaatccctggaaaggagggcgtggctatatcggccccgtggatccctccgcccgcgcttgttgtgctgaggccgagggagtcgccattttggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaaaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgt

SEQ ID NO: 439099 - DNA, 501 bp, Homo sapiens
  misc_feature (114)..(114): n is a, c, g, or t
  misc_feature (132)..(132): n is a, c, g, or t
  misc_feature (134)..(134): n is a, c, g, or t
  misc_feature (141)..(141): n is a, c, g, or t
cgatttatttcggtaattccagggttttcccactaaatatgttggaaaacaaggtccagttagtcttaataggactcactatagttggaaatgggtctcgggccgcccctcttnccgtctctctcactctcncnctctctntctctctctctctctctctctctctctctctctctctctctctctctctctcctcgtgccgaattcggcaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439100 - DNA, 5668 bp, Homo sapiens
gggggaatcgcgtaatggcggacacaggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439101 - DNA, 5628 bp, Homo sapiens
cagcctgctataccaccaccgctttctgataccaccaagcccaagtcctccttgcctgccgggagcacactctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439102 - DNA, 5404 bp, Homo sapiens
agaggaaccagtggtagaaatcccctctgatgtaccaggaaatccgaatatcctcagggagatctctgtggccatgcagatcatcagaagtaatcaggatccctgctgctatcacctgtacttgccctgacaatgcacattcatctaccaggaattgaaagtaaggctaaggttcttaaaaagtctgataagtagagaggtgccattcgggggcattgaaatgctggtatgggagaggaggtatgcaatcgattcaaatgacttcttgattccttggtgtaaaaactgctaactggtaggtgtttggaatattggatttggttgggagctcatctgtctactgacagctacttgtcttcatttctatcccagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439103 - DNA, 4261 bp, Homo sapiens
tgagttcttaaagactgaagacaggctattctctggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439104 - DNA, 4381 bp, Homo sapiens
tccccacttcaaagccttatgagaagtcctcaccagcctgaaagtgtgtaaaccagaaaggacagcaggctgcctttcagacacacctgtgacatcagggccatcaatttcataaactcatcttcttctgcttttccataacaaccttctttttctctatcctttccaataccacttacccattggtggccactccctcttacccagttccagatggattccaaggctgaggacacgccttcctcacccttctgtctctttgccactaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439105 - DNA, 3823 bp, Homo sapiens
ttgtgggtgatctagaggatccctcttctcgaaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439106 - DNA, 3635 bp, Homo sapiens
gcaggctggtactggccccggattttaggatcagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439107 - DNA, 3622 bp, Homo sapiens
gggggaatcgcgtaatggcggacacaggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggttgtttttcaccattcagaacactgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439108 - DNA, 5173 bp, Homo sapiens
  misc_feature (4985)..(4985): n is a, c, g, or t
  misc_feature (5059)..(5059): n is a, c, g, or t
  misc_feature (5120)..(5121): n is a, c, g, or t
  misc_feature (5124)..(5124): n is a, c, g, or t
gggggaatcgcgtaatggcggacacaggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcctgcggaaggtaggattagatcattagctcagtgacctcctagggtttcgatgtgctatgttctcatcctacagttggtttggtaatgatctncaagtcccggagagcaacagcacagctctgcctgacgctctcattaaaatctatgcagccaagctcggcacttngtagcagccggccttgcgaagcctcctcagctcggggggccggggacccagtgagccgagnngcntctgggctccacttatgcatatgcaccaaaaaaaaaaaaaaaaaaaaaa

SEQ ID NO: 439109 - DNA, 2564 bp, Homo sapiens
gcggccgcctactactactactactgctcgaattcaagcttctaacgatgtacggggacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439110 - DNA, 2344 bp, Homo sapiens
attgtattaagtttattcagttaattcacttgaggaactaaccagtttttactttctgtctagaatgatgtacatgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439111 - DNA, 3265 bp, Homo sapiens
gggggaatcgcgtaatggcggacacaggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaaaaaaaaaaaaaaaaaaaaaaaa

SEQ ID NO: 439112 - DNA, 2778 bp, Homo sapiens
gggggaatcgcgtaatggcggacacaggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439113 - DNA, 698 bp, Homo sapiens
agacctggcgcctttacacagggtaaggagtccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439114 - DNA, 2251 bp, Homo sapiens
gggggaatcgcgtaatggcggacacaggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaagggcaggtgacagatcccaacagcggtttcaccatcgaggacagactgttatgacgagagattacgaattctcgtgcgtcggactactcttctccgacaggcaacatcccttgaacttgtcgcctccagattagagcctccctctgccctcataatccttattctaggttagtgcattttgtgtttagtttacgaaacccttctcttctctatcctaaggtcatgaagctattctcctatgtgctttcggagaagaggggatcctgat

SEQ ID NO: 439115 - DNA, 485 bp, Homo sapiens
ggtgggttcttataaatatgtttgtatcagagaaaacaaggcactttgggagcattatggcttactctactacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439116 - DNA, 852 bp, Homo sapiens
gggggaatcgcgtaatggcggacacaggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtgagtgcctcagagagcctgtgctttgccctcaggggtcgttggtgctctttatttagtttccttctcctcccgcgttcctatttctcccccatctgccttccctaggtaatgcgaaaatgtatcctccctctcctccccaaagagaggctcccttttggtgtagcttcttctcttcaaccttctttatctaccaccaccctctaggttccctcctccctccccctccacctgcttcaacagaaatctgtgggaagggtggcaggaagggctgcagcaaaaactgcagacggaatgacagagcagaattctgtgtgtgtaaagtgggaggttcacagagcagtatcttgggtcggggaatgtgcctgtaattacacgagctgttcgatgtagcctgactttgttgaagcctcaaatgtgccaatagtttttatctacccaacacccccaccccttttcttcccaaagaggagtaaagcaaacatgccttcggagagattctgac

SEQ ID NO: 439117 - DNA, 573 bp, Homo sapiens
agggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagcacacctctggtgtttgtggta

SEQ ID NO: 439118 - DNA, 652 bp, Homo sapiens
tatttggagtctcgctccgtcacccaggatggggtgcagtggctcggtcttggctcactgcaacctccgcctcccgaggtcaagcaattctcctgcctcaacctccccagtagctgggattataggtgcctgccagcacgcctgtctaatttttgtatttttagtagagacggggtttccccatgttgcccaggctggaaatgtgtagaaatattatcttttcttccaggcttaattttttgcattacacctttcagttttattcagcctgttttgagtctcatgactgttcacgtctgtcaagaagactctattagttatagaacatatgcaggcttcctaaactatgaagagtatttctctgtctctaagagcagtcatctgcatatagcccaaaccgtcttagggtatgtgtgtgtatatgtatgtgtttgggggttagggaacacgatctttagtagccagtttttgtgaccatttacgttacttctatgcactagtgacttggtttctttgctctttccagggctcttctatgaaacagttacaaacctatggccagtgcaggcagtggctcacacctgtaaatccagcactttggactgctggggaggaggacacttgaggcaggagccgagacagctgggcacat

SEQ ID NO: 439119 - DNA, 5847 bp, Homo sapiens
tatttggagtctcgctccgtcacccaggatggggtgcagtggctcggtcttggctcactgcaacctccgcctcccgaggtcaagcaattctcctgcctcaacctccccagtagctgggattataggtgcctgccagcacgcctgtctaatttttgtatttttagtagagacggggtttccccatgttgcccaggctggaaatgtgtagaaatattatcttttcttccaggcttaattttttgcattacacctttcagttttattcagcctgttttgagtctcatgactgttcacgtctgtcaagaagactctattagttatagaacatatgcaggcttcctaaactatgaagagtatttctctgtctctaagagcagtcatctgcatatagcccaaaccgtcttagggtatgtgtgtgtatatgtatgtgtttgggggttagggaacacgatctttagtagccagtttttgtgaccatttacgttacttctatgcactagtgacttggtttctttgctctttccaggtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439120 - DNA, 4943 bp, Homo sapiens
gctgaggtcgctctagagtatcccataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439121 - DNA, 5601 bp, Homo sapiens
gggggaatcgcgtaatggcggacacaggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagaagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439122 - DNA, 5535 bp, Homo sapiens
gggggaatcgcgtaatggcggacacaggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439123 - DNA, 4938 bp, Homo sapiens
  misc_feature (4572)..(4573): n is a, c, g, or t
gggggaatcgcgtaatggcggacacaggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctggacaaggacannagatagcccactcctgtgcaggccacgcgaggttcccacttctcaaggtgcgagacaggcaatgctggtcacgtatagaagctatctagcacaggtaaccgaaaatgctcccggtaactacttacagtaaaggcatttaactcaggcccaagccttcgattctaactatacacctagaacagaacatgcaactagaacgttaatgacccataccagcctttcttaaactttccctctttttatctacaaccaactgcaacctttactgcaacactggcgttgacaaccaggccgatgggcccctcggtcttttatccgagtccgtggacccttctccaagtccgctgatccgccgcacatcccct

SEQ ID NO: 439124 - DNA, 2402 bp, Homo sapiens
ggtttctctttgtttcaggctctgaaagccggagaagccagcagaagccgatttcagcataagaggctacacaatagttagggcagaagaaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaagggtttttttagaacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439125 - DNA, 1369 bp, Homo sapiens
  misc_feature (35)..(36): n is a, c, g, or t
gtaaactgcataaatgcctcggcaaagataaaggnnccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439126 - DNA, 2680 bp, Homo sapiens
gggggaatcgcgtaatggcggacacaggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagccctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagca

SEQ ID NO: 439127 - DNA, 363 bp, Homo sapiens
acatccattgtccttaaagacttttccagagtgattgaaaccattgatttgtggaactgcaacaatatttctcaagagtttacaattgtcttacaccaccaatcagaaatatgtttggggaggcatgggtggcagggggcaacatgagccatttccatactgctccccatactacctgtgttggttccttaagcaaaaaggcctccagccttcattaaatcctataaacaaacattacatcccatgaatcattatcaactttcttcctttactccacctctgcccccctctggattttgcatacagcctcatacagtgcaaacaaggatgtgacttgctcagcttagtcatgtgatttattta

SEQ ID NO: 439128 - DNA, 1498 bp, Homo sapiens
acatccattgtccttaaagacttttccagagtgattgaaaccattgatttgtggaactgcaacaatatttctcaagagtttacaattgtcttacaccaccaatcagaaatatgtttggggaggcatgggtggcagggggcaacatgagccatttccatactgctccccatactacctgtgttggttccttaagcaaaaaggcctccagccttcattaaatcctataaacaaacattacatcccatgaatcattatcaactttcttcctttactccacctcccccattttatcttcaattctcaggctatagaatagacaagttttagaatatacttcagccaaagcagaaagattttcatagatccaatatgcaaatagttctgctgtgacatagatcagaaattgtctgttccttaatatttgggggtggaggcaacaaaactgaagcatatttctgattggttagccattttggcctgtttcctcttgcatgttttttagggagagagggaaacagtcctgtatttcttctgatgccctttggggaagccgacgaccactgggcatttctcactgttactcctgttcaagagagggcttctcagtctgcactgaaaaatgcaaattaaactggatctttatgtcaatgtgtacatagtacaagcttttttactggaattgaggtttaaaaccacacactgcccttttggtggtgtgcctgttgggccaaaaattgggtgataatgtagtgtcactttctcagctcaatgcagtttctactttttcttatgggaaaatttttcataaaacctttttgcaccaaaacccaggggtgttttttgcaatatccttgttatcctcgtagtgtgccaagtcagaggctttctcttgcccttttcctgctgtgttctcaggcctcccaagggctgtttgactcaacagtctacatccttcgttgtgttttggagaatgtgggggtgggggtcagagttcaaggtgtctgttcccttttcctgtgaactctttctagtccctatttggggagggtggctggaaacagatttttgctgaatttctggctcagatcttctagccaggaaaggcaagagcccccaagagcccttttttttgacatacactaatcattggccggggtcttggtgacaacttttaaaatcccaaatagttttatttggattatgtaaaagtaagtgtgaaacatgggaacaacggacttccactgagcgatgtgaaaacgttacaggttcagtacttccaaaggaagaaacctccaaacccaaaaaagaataaatatgaatttgtatttttgaagaatgtgaaataatggtgtttgcttaattgctcattttgtataaacttaatattgtactttaaaatatctgctaaaaagtgaaaatttaactttttggaattgaaaaagcaatattaaatactaatgaaatcctaattaaatgcttatttaaatctggtagtatc

SEQ ID NO: 439129 - DNA, 1388 bp, Homo sapiens
acatccattgtccttaaagacttttccagagtgattgaaaccattgatttgtggaactgcaacaatatttctcaagagtttacaattgtcttacaccaccaatcagaaatatgtttggggaggcatgggtggcagggggcaacatgagccatttccatactgctccccatactacctgtgttggttccttaagcaaaaaggcctccagccttcattaaatcctataaacaaacattacatcccatgaatcattatcaactttcttcctttactccacctcccccattttatcttcaattctcaggctatagaatagacaagttttagaatatacttcagccaaagcagaaagattttcatagatccaatatgcaaatagttctgctgtgacatagatcagaaattgtctgttccttaatatttgggggtggaggcaacaaaactgaagcatatttctgattggttagccattttggcctgtttcctcttgcatgttttttagggagagagggaaacagtcctgtatttcttctgatgccctttggggaagccgacgaccactgggcatttctcactgttactcctgttcaagagagggcttctcagtctgcactgaaaaatgcaaattaaactggatctttatgtcaatgtgtacatagtacaagcttttttactggaattgaggtttaaaaccacacactgcccttttggtggtgtgcctgttgggccaaaaattgggtgataatgtagtgtcactttctcagctcaatgcagtttctactttttcttatgggaaaatttttcataaaacctttttgcaccaaaacccaggggtgttttttgcaatatccttgttatcctcgtagtgtgccaagtcagagttcaaggtgtctgttcccttttcctgtgaactctttctagtccctatttggggagggtggctggaaacagatttttgctgaatttctggctcagatcttctagccaggaaaggcaagagcccccaagagcccttttttttgacatacactaatcattggccggggtcttggtgacaacttttaaaatcccaaatagttttatttggattatgtaaaagtaagtgtgaaacatgggaacaacggacttccactgagcgatgtgaaaacgttacaggttcagtacttccaaaggaagaaacctccaaacccaaaaaagaataaatatgaatttgtatttttgaagaatgtgaaataatggtgtttgcttaattgctcattttgtataaacttaatattgtactttaaaatatctgctaaaaagtgaaaatttaactttttggaattgaaaaagcaatattaaatactaatgaaatcctaattaaatgcttatttaaatctggtagtatc

SEQ ID NO: 439130 - DNA, 400 bp, Homo sapiens
gaggaatgaaagtggcggtctcgccggcagttggtcccgggccctggggctcgggagtcgggggcggtgggacagtgcggctactcttgatcctctccggctgcttggtctacggcacagctgaaactgatgtaaatgtggtcatgcttcaggaatcccaagtttgtgaaaagcgtgccagccaacaattctgttacacaaatgtgcttatcccaaaatggcatgatatatggacacggatacagatccgagtaaatagttccagattggttcgagtcacccaggtggagaatgaggagaaactgaaggagctagagcactgcaaatgccggactcctaaactgcgatgactgagagacttgaggcctctctgcttatactcagtcatgtactatcccgg

SEQ ID NO: 439131 - DNA, 5493 bp, Homo sapiens
tcgtagaggataggctgctgtcgttgcccgttcggagttagttgctgggctgaaactgatgtaaatgtggtcatgcttcaggaatcccaagtttgtgaaaagcgtgccagccaacaattctgttacacaaatgtgcttatcccaaaatggcatgatatatggacacggatacagatccgagtaaatagttccagattggttcgagtcacccaggtggagaatgaggagaaactgaaggagctagagcagtttagtatctggaactttttttcctcctttttaaaagagaaattgaatgacacctatgttaacgtgggtctatacagcacaaaaacctgcctcaaagttgagattatagagaaggacaccaagtacagtgtcattgtgatccggagatttgatcccaaactctttcttgttttccttcttggacttatgctatttttttgtggagacttgctgagcagaagtcaaattttctactactctactgggatgactgtgggaattgtggcctctctgctaatcatcatttttatactatctaagtttatgcctaagaaaagtcccatttacgtcatcctggtgggaggctggtctttttctctgtacctcattcaactagtttttaaaaatttacaagagatctggaggtgttactggcagtatcttttaagttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcagtgactttagaataattattgatttaactgttttgggaggaaaatagatttttattgttttgttttttaaatgaatgtcttttaaaaaacataacaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttaggaacatgcctgtaggctcttctgcaggtgagatgtactgggctttttattatattcaactttcaattccatcttaaaaaacatttgtattcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttttaccttatttatagaaattgagacctagcatatttaagcataagtttattttaaaaaataattcaactcgtgcaagtggtctcaggattctctggagattttggtgcctcccctacttagggaggtgatagcttgcctataagggtgacttttcctgatcatgtctttatttcaatgagaaagcactgtgaaattgtgaaagattctcctctttctctgtttaataaacccccatgaaatatagtttccatctctagaccagttttttttccaccgtgtttagacttgaggtgaataaaatcaaactgttttttactccctatctggtagttggagacctgagctgtaggcagtggagatggcaattggttctgcagcctgagagttgctctcacacagtgaaggacggtgctgctctggtgtgctgtgtgtccttgccctgcctgcctgtggctctgcccagatgcttcagatcctctgtgttccggagattgcttgacttcaaccttctttaggagctgctcttgtctccctcttggccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttatagata

SEQ ID NO: 439132 - DNA, 5247 bp, Homo sapiens
tatgcagtgggaaaccaaaaaatttgtgtgacttacttactgcaattgcaatatttggtttattgcagtggtctggaaccaaatttgaaatgtctctgatgcttgtactgctctaatcttgtaccttttaaaatctttcggctgggttagttgtcctagtttcaacagtgctatgtatgaaatatatacatatggtcatgaaatacatttttttcctgcagaagtcaaattttctactactctactgggatgactgtgggaattgtggcctctctgctaatcatcatttttatactatctaagtttatgcctaagaaaagtcccatttacgtcatcctggtgggaggctggtctttttctctgtacctcattcaactagtttttaaaaatttacaagagatctggaggtgttactggcagtatcttttaagttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcagtgactttagaataattattgatttaactgttttgggaggaaaatagatttttattgttttgttttttaaatgaatgtcttttaaaaaacataacaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttaggaacatgcctgtaggctcttctgcaggtgagatgtactgggctttttattatattcaactttcaattccatcttaaaaaacatttgtattcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttttaccttatttatagaaattgagacctagcatatttaagcataagtttattttaaaaaataattcaactcgtgcaagtggtctcaggattctctggagattttggtgcctcccctacttagggaggtgatagcttgcctataagggtgacttttcctgatcatgtctttatttcaatgagaaagcactgtgaaattgtgaaagattctcctctttctctgtttaataaacccccatgaaatatagtttccatctctagaccagttttttttccaccgtgtttagacttgaggtgaataaaatcaaactgttttttactccctatctggtagttggagacctgagctgtaggcagtggagatggcaattggttctgcagcctgagagttgctctcacacagtgaaggacggtgctgctctggtgtgctgtgtgtccttgccctgcctgcctgtggctctgcccagatgcttcagatcctctgtgttccggagattgcttgacttcaaccttctttaggagctgctcttgtctccctcttggccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttatagata

SEQ ID NO: 439133 - DNA, 1454 bp, Homo sapiens
  misc_feature (22)..(22): n is a, c, g, or t
ggctggtacggtcgggagttanggattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttatagata

SEQ ID NO: 439134 - DNA, 843 bp, Homo sapiens
attaataacatatgaaatatccatttgcaaaaggtttaggtgcctttgccttgtgcaatggatatttcatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttatagata

SEQ ID NO: 439135 - DNA, 3153 bp, Homo sapiens
tcgtagaggataggctgctgtcgttgcccgttcggagttagttgctgggctgaaactgatgtaaatgtggtcatgcttcaggaatcccaagtttgtgaaaagcgtgccagccaacaattctgttacacaaatgtgcttatcccaaaatggcatgatatatggacacggatacagatccgagtaaatagttccagattggttcgagtcacccaggtggagaatgaggagaaactgaaggagctagagcagtttagtatctggaactttttttcctcctttttaaaagagaaattgaatgacacctatgttaacgtgggtctatacagcacaaaaacctgcctcaaagttgagattatagagaaggacaccaagtacagtgtcattgtgatccggagatttgatcccaaactctttcttgttttccttcttggacttatgctatttttttgtggagacttgctgagcagaagtcaaattttctactactctactgggatgactgtgggaattgtggcctctctgctaatcatcatttttatactatctaagtttatgcctaagaaaagtcccatttacgtcatcctggtgggaggctggtctttttctctgtacctcattcaactagtttttaaaaatttacaagagatctggaggtgttactggcagtatcttttaagttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcagtgactttagaataattattgatttaactgttttgggaggaaaatagatttttattgttttgttttttaaatgaatgtcttttaaaaaacataacaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttaggaacatgcctgtaggctcttctgcaggtgagatgtactgggctttttattatattcaactttcaattccatcttaaaaaacatttgtattcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatata

SEQ ID NO: 439136 - DNA, 337 bp, Homo sapiens
tatgcagtgggaaaccaaaaaatttgtgtgacttacttactgcaattgcaatatttggtttattgcagtggtctggaaccaaatttgaaatgtctctgatgcttgtactgctctaatcttgtaccttttaaaatctttcggctgggttagttgtcctagtttcaacagtgctatgtatgaaatatatacatatggtcatgaaatacatttttttcctgcagaagtcaaattttctactactctactgggatgactgtgggaattgtggcctctctgctaatcatcatttttatactatctaagtttatgcctaaggtaagtatcagaatcttcatgt

SEQ ID NO: 439137 - DNA, 5564 bp, Homo sapiens
gaggaatgaaagtggcggtctcgccggcagttggtcccgggccctggggctcgggagtcgggggcggtgggacagtgcggctactcttgatcctctccggctgcttggtctacggcacagctgaaactgatgtaaatgtggtcatgcttcaggaatcccaagtttgtgaaaagcgtgccagccaacaattctgttacacaaatgtgcttatcccaaaatggcatgatatatggacacggatacagatccgagtaaatagttccagattggttcgagtcacccaggtggagaatgaggagaaactgaaggagctagagcagtttagtatctggaactttttttcctcctttttaaaagagaaattgaatgacacctatgttaacgtgggtctatacagcacaaaaacctgcctcaaagttgagattatagagaaggacaccaagtacagtgtcattgtgatccggagatttgatcccaaactctttcttgttttccttcttggacttatgctatttttttgtggagacttgctgagcagaagtcaaattttctactactctactgggatgactgtgggaattgtggcctctctgctaatcatcatttttatactatctaagtttatgcctaagaaaagtcccatttacgtcatcctggtgggaggctggtctttttctctgtacctcattcaactagtttttaaaaatttacaagagatctggaggtgttactggcagtatcttttaagttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcagtgactttagaataattattgatttaactgttttgggaggaaaatagatttttattgttttgttttttaaatgaatgtcttttaaaaaacataacaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttaggaacatgcctgtaggctcttctgcaggtgagatgtactgggctttttattatattcaactttcaattccatcttaaaaaacatttgtattcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttttaccttatttatagaaattgagacctagcatatttaagcataagtttattttaaaaaataattcaactcgtgcaagtggtctcaggattctctggagattttggtgcctcccctacttagggaggtgatagcttgcctataagggtgacttttcctgatcatgtctttatttcaatgagaaagcactgtgaaattgtgaaagattctcctctttctctgtttaataaacccccatgaaatatagtttccatctctagaccagttttttttccaccgtgtttagacttgaggtgaataaaatcaaactgttttttactccctatctggtagttggagacctgagctgtaggcagtggagatggcaattggttctgcagcctgagagttgctctcacacagtgaaggacggtgctgctctggtgtgctgtgtgtccttgccctgcctgcctgtggctctgcccagatgcttcagatcctctgtgttccggagattgcttgacttcaaccttctttaggagctgctcttgtctccctcttggccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttatagata

SEQ ID NO: 439138 - DNA, 5345 bp, Homo sapiens
gaggaatgaaagtggcggtctcgccggcagttggtcccgggccctggggctcgggagtcgggggcggtgggacagtgcggctactcttgatcctctccggctgcttggtctacggcacagctgaaactgatgtaaatgtggtcatgcttcaggaatcccaagtttgtgaaaagcgtgccagccaacaattctgttacacaaatgtgcttatcccaaaatggcatgatatatggacacggatacagatccgagtaaatagttccagattggttcgagtcacccaggtggagaatgaggagaaactgaaggagctagagcaaagtcaaattttctactactctactgggatgactgtgggaattgtggcctctctgctaatcatcatttttatactatctaagtttatgcctaagaaaagtcccatttacgtcatcctggtgggaggctggtctttttctctgtacctcattcaactagtttttaaaaatttacaagagatctggaggtgttactggcagtatcttttaagttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcagtgactttagaataattattgatttaactgttttgggaggaaaatagatttttattgttttgttttttaaatgaatgtcttttaaaaaacataacaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttaggaacatgcctgtaggctcttctgcaggtgagatgtactgggctttttattatattcaactttcaattccatcttaaaaaacatttgtattcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttttaccttatttatagaaattgagacctagcatatttaagcataagtttattttaaaaaataattcaactcgtgcaagtggtctcaggattctctggagattttggtgcctcccctacttagggaggtgatagcttgcctataagggtgacttttcctgatcatgtctttatttcaatgagaaagcactgtgaaattgtgaaagattctcctctttctctgtttaataaacccccatgaaatatagtttccatctctagaccagttttttttccaccgtgtttagacttgaggtgaataaaatcaaactgttttttactccctatctggtagttggagacctgagctgtaggcagtggagatggcaattggttctgcagcctgagagttgctctcacacagtgaaggacggtgctgctctggtgtgctgtgtgtccttgccctgcctgcctgtggctctgcccagatgcttcagatcctctgtgttccggagattgcttgacttcaaccttctttaggagctgctcttgtctccctcttggccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttatagata

SEQ ID NO: 439139 - DNA, 5439 bp, Homo sapiens
tcgtagaggataggctgctgtcgttgcccgttcggagttagttgctgggctgaaactgatgtaaatgtggtcatgcttcaggaatcccaagtttgtgaaaagcgtgccagccaacaattctgttacacaaatgtgcttatcccaaaatggcatgatatatggacacggatacagatccgagtaaatagttccagattggttcgagtcacccaggtggagaatgaggagaaactgaaggagctagagcagtttagtatctggaactttttttcctcctttttaaaagagaaattgaatgacacctatgttaacgtgggtctatacagcacaaaaacctgcctcaaagttgagattatagagaaggacaccaagtacagtgtcattgtgatccggagatttgatcccaaactctttcttgttttccttcttggacttatgctatttttttgtggagacttgctgagcagaagtcaaattttctactactctactgggatgactgtgggaattgtggcctctctgctaatcatcatttttatactatctaagtttatgcctaagaaaagtcccatttacgtcatcctggtgggaggctggtctttttctctgtacctcattcaactagtttttaaaaatttacaagagatctggaggtgttactggcagtatcttttaagttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcagtgactttagaataattattgatttaactgttttgggaggaaaatagatttttattgttttgttttttaaatgaatgtcttttaaaaaacataacaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttaggaacatgcctgtaggctcttctgcaggtgagatgtactgggctttttattatattcaactttcaattccatcttaaaaaacatttgtattcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttttaccttatttatagaaattgagacctagcatatttaagcataagtttattttaaaaaataattcaactcgtgcaagtggtctcaggattctctggagattttggtgcctcccctacttagggaggtgatagcttgcctataagggtgacttttcctgatcatgtctttatttcaatgagaaagcactgtgaaattgtgaaagattctcctctttctctgtttaataaacccccatgaaatatagtttccatctctagaccagttttttttccaccgtgtttagacttgaggtgaataaaatcaaactgttttttactccctatctggtagttggagacctgagctgtaggcagtggagatggcaattggttctgcagcctgagagttgctctcacacagtgaaggacggtgctgctctggtgtgctgtgtgtccttgccctgcctgcctgtggctctgcccagatgcttcagatcctctgtgttccggagattgcttgacttcaaccttctttaggagctgctcttgtctccctcttggccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtagaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttatagata

SEQ ID NO: 439140 - DNA, 772 bp, Homo sapiens
aggcttctgggatatgacagcattgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgagcctctggtagcctttcaaccatgcattccatctaagctctgcaaaattgaagaggctgactgcaagaataaatttcgctgtgacagtggccgctgcattgccagaaagttagaatgcactggagtatgcacacagaagtataatcccatccctagtgtacagctgatgggctggggttcatctttctgcacgagagcccagagagaggcccttgtactctctactgaggatatgtctg

SEQ ID NO: 439141 - DNA, 383 bp, Homo sapiens
aggcttctgggatatgacagcattgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccagggatgccccatcctgcctcctgggagattttggcc

SEQ ID NO: 439142 - DNA, 3637 bp, Homo sapiens
aggcttctgggatatgacagcattgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgagcctctggtagcctttcaaccatgcattccatctaagctctgcaaaattgaagaggctgactgcaagaataaatttcgctgtgacagtggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtttcattttctggcaggagagcccagaggagaagtccttgataactctttcactggaggaatatgtaaaactgtcaaaagcagtaggacaagtaatccataccgtgttccggccaatctggaaaatgtcggctttgaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaaggattctagttttattaggatccataaagtgatgaaagtcttaaacttcacaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtttaaccgaggaagaagccaaacactgtgtcaggattgaaacaaagaaacgcgttttatttgctaagaaaacaaaagtggaacataggtgcaccaccaacaagctgtcagagaaacatgaaggttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccaatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaatggacaaccatgtatcaatgatgatgaagaaatgaaagaggtcgatcttcctgagatagaagcagattccgggtgtcctcagccagttcctccagaaaatggatttatccggaatgaaaagcaactatacttggttggagaagatgttgaaatttcatgccttactggctttgaaactgttggataccagtacttcagatgcttaccagacgggacctggagacaaggggatgtggaatgccaacggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaagatactctaacacaattgtcttcagaagaagactgtagccatcattcagaagatctctgtgtgtttgacacagactccaacgattactttacttcacccgcttgtaagtttttggctgagaaatgtttaaataatcagcaactccattttctacatattggttcctgccaagacggccgccagttagaatggggtcttgaaaggacaagactttcatccaacagcacaaagaaagaatcctgtggctatgacacctgctatgactgggaaaaatgttcagcctccacttccaaatgtgtctgcctattgcccccacagtgcttcaagggtggaaaccaactctactgtgtcaaaatgggatcatcaacaagtgagaaaacattgaacatctgtgaagtgggaactataagatgtgcaaacaggaagatggaaatactgcatcctggaaagtgtttggcctagcacaattactgctaggcccagcacaatgaacagatttaccatcccgaagaaccaactcctacaaatgagaattcttgcacaaacagcagactggcatgctcaaagttactgacaaaaattattttctgttagtttgagatcattattctcccctgactctcctgtttgggcatgtcttattcagttccagctcatgacgccctgtagcatacccctaggtaccaacttccacagcagtctcgtaaattctcctgttcacattgtacaaaaataatgtgacttctgaggcccttatgtagcctgtgacattaagcattctcacaattagaaataagaataaaacccataattttcttcaatgagttaataaacagaaatctccagaacctctgaaacacattcttgaagcccagctttcatatcttcattcaacaaataatttctgagtgtgtatacaggatgtcaagtactgaccaaagtcctgagaactcggcagataataaaacagacaaaagcctttgccttcatgaagcatacattcattcaggggtagacacacaaaaaatgaaataaacaggtaaaatatgtagcatgtttgatggtgataattgttttggagaaaatacaacacggaagggtgagtcccatccttaattatcatcttatgcaaggaaatattccataacaataaacatcgctgtaaggatga

SEQ ID NO: 439143 - DNA, 3298 bp, Homo sapiens
aggcttctgggatatgacagcattgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgagcctctggtagcctttcaaccatgcattccatctaagctctgcaaaattgaagaggctgactgcaagaataaatttcgctgtgacagtggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtttcattttctggcaggagagcccagaggagaagtccttgataactctttcactggaggaatatgtaaaactgtcaaaagcagtaggacaagtaatccataccgtgttccggccaatctggaaaatgtcggctttgaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaaggattctagttttattaggatccataaagtgatgaaagtcttaaacttcacaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtttaaccgaggaagaagccaaacactgtgtcaggattgaaacaaagaaacgcgttttatttgctaagaaaacaaaagtggaacataggtgcaccaccaacaagctgtcagagaaacatgaaggttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccaatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaatggacaaccatgtatcaatgatgatgaagaaatgaaagaggtcgatcttcctgagatagaagcagattccgggtgtcctcagccagttcctccagaaaatggatttatccggaatgaaaagcaactatacttggttggagaagatgttgaaatttcatgccttactggctttgaaactgttggataccagtacttcagatgcttaccagacgggacctggagacaaggggatgtggaatgccaacggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaagtctactgtgtcaaaatgggatcatcaacaagtgagaaaacattgaacatctgtgaagtgggaactataagatgtgcaaacaggaagatggaaatactgcatcctggaaagtgtttggcctagcacaattactgctaggcccagcacaatgaacagatttaccatcccgaagaaccaactcctacaaatgagaattcttgcacaaacagcagactggcatgctcaaagttactgacaaaaattattttctgttagtttgagatcattattctcccctgactctcctgtttgggcatgtcttattcagttccagctcatgacgccctgtagcatacccctaggtaccaacttccacagcagtctcgtaaattctcctgttcacattgtacaaaaataatgtgacttctgaggcccttatgtagcctgtgacattaagcattctcacaattagaaataagaataaaacccataattttcttcaatgagttaataaacagaaatctccagaacctctgaaacacattcttgaagcccagctttcatatcttcattcaacaaataatttctgagtgtgtatacaggatgtcaagtactgaccaaagtcctgagaactcggcagataataaaacagacaaaagcctttgccttcatgaagcatacattcattcaggggtagacacacaaaaaatgaaataaacaggtaaaatatgtagcatgtttgatggtgataattgttttggagaaaatacaacacggaagggtgagtcccatccttaattatcatcttatgcaaggaaatattccataacaataaacatcgctgtaaggatga

SEQ ID NO: 439144 - DNA, 2844 bp, Homo sapiens
aggcttctgggatatgacagcattgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgagcctctggtagcctttcaaccatgcattccatctaagctctgcaaaattgaagaggctgactgcaagaataaatttcgctgtgacagtggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtttcattttctggcaggagagcccagaggagaagtccttgataactctttcactggaggaatatgtaaaactgtcaaaagcagtaggacaagtaatccataccgtgttccggccaatctggaaaatgtcggctttgaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaaggattctagttttattaggatccataaagtgatgaaagtcttaaacttcacaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtttaaccgaggaagaagccaaacactgtgtcaggattgaaacaaagaaacgcgttttatttgctaagaaaacaaaagtggaacataggtgcaccaccaacaagctgtcagagaaacatgaaggttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccaatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaatggacaaccatgtatcaatgatgatgaagaaatgaaagaggtcgatcttcctgagatagaagcagattccgggtgtcctcagccagttcctccagaaaatggatttatccggaatgaaaagcaactatacttggttggagaagatgttgaaatttcatgccttactggctttgaaactgttggataccagtacttcagatgcttaccagacgggacctggagacaaggggatgtggaatgccaacggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaagacctggacacctcccttagcccttcagaggatcctcttgccctgagcactttacagactgtggagtatttgttgctcctgtgctgggaggtgtgggcagctgagtcccagcactgcttcaacctgaggctgattggaagagcagattccttgcataagatcattgacaatttcaaacctgtagtgatagagcaaggctgtgtgccacttgaaagctgaattgattctttttggaaacaatgtataccttgctgctcctcccaggcctaattacaaagggcaaagaggcacaaattctcttacaaaataaaaaggcatttcagctgggaccgaaccatcagaactgaaggctatggttgtttccaaaaagatgtgccc

SEQ ID NO: 439145 - DNA, 735 bp, Homo sapiens
ggagactagagaatgtaactggcaaagatgccccatcaactgcctcctgggagattttggaccatggtcagactgtgacccttgtattgaaaaacagaggtaggcaaccatgggcatttccaggaaatatgaatcacaatagagggctctgattccctgacaggcttaacagcatagtaatgctgaattacttcaatttctgaaaatcaactgtctcagcttccattgagggaaaattccatttagcacttttgtggggggaagagggggtttattttatgtattttactgtcttaagaacacaaaaaggaaattttgctcccagtattgatattgtacttacccagttctgaattccactgcctgtgccttctgagaattctgaaagcaaaagtgtatacagattgagtaatccttatccaaaatgttggtatcagaagtgttttggattttggatgttttgtggattctgaaatatttgcatatacataacgtagtagcttggggatgggacacagtctaaacatgaaattcatttatgtttcagatataccttatacatatagcctgaagataatttatacaatattttaaataattttgttcatgagacaaatttatgataagtatttacatatacaatactccactgtggcatcatgttggtactcaaaaatttttagatattggagcattttggattttaggttttcaaactaggtatgctcaactcgt

SEQ ID NO: 439146 - DNA, 3691 bp, Homo sapiens
aggcttctgggatatgacagcattgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgagcctctggtagcctttcaaccatgcattccatctaagctctgcaaaattgaagaggctgactgcaagaataaatttcgctgtgacagtggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtttcattttctggcaggagagcccagaggagaagtccttgataactctttcactggaggaatatgtaaaactgtcaaaagcagtaggacaagtaatccataccgtgttccggccaatctggaaaatgtcggctttgaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaaggattctagttttattaggatccataaagtgatgaaagtcttaaacttcacaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtttaaccgaggaagaagccaaacactgtgtcaggattgaaacaaagaaacgcgttttatttgctaagaaaacaaaagtggaacataggtgcaccaccaacaagctgtcagagaaacatgaaggttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccaatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaatggacaaccatgtatcaatgatgatgaagaaatgaaagaggtcgatcttcctgagatagaagcagattccgggtgtcctcagccagttcctccagaaaatggatttatccggaatgaaaagcaactatacttggttggagaagatgttgaaatttcatgccttactggctttgaaactgttggataccagtacttcagatgcttaccagacgggacctggagacaaggggatgtggaatgccaacggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaagatactctaacaaaattaaaaggccattgtcagctgggacagaaacaatcaggatctgaatgcatttgtatgtctccagaagaagactgtagccatcattcagaagatctctgtgtgtttgacacagactccaacgattactttacttcacccgcttgtaagtttttggctgagaaatgtttaaataatcagcaactccattttctacatattggttcctgccaagacggccgccagttagaatggggtcttgaaaggacaagactttcatccaacagcacaaagaaagaatcctgtggctatgacacctgctatgactgggaaaaatgttcagcctccacttccaaatgtgtctgcctattgcccccacagtgcttcaagggtggaaaccaactctactgtgtcaaaatgggatcatcaacaagtgagaaaacattgaacatctgtgaagtgggaactataagatgtgcaaacaggaagatggaaatactgcatcctggaaagtgtttggcctagcacaattactgctaggcccagcacaatgaacagatttaccatcccgaagaaccaactcctacaaatgagaattcttgcacaaacagcagactggcatgctcaaagttactgacaaaaattattttctgttagtttgagatcattattctcccctgactctcctgtttgggcatgtcttattcagttccagctcatgacgccctgtagcatacccctaggtaccaacttccacagcagtctcgtaaattctcctgttcacattgtacaaaaataatgtgacttctgaggcccttatgtagcctgtgacattaagcattctcacaattagaaataagaataaaacccataattttcttcaatgagttaataaacagaaatctccagaacctctgaaacacattcttgaagcccagctttcatatcttcattcaacaaataatttctgagtgtgtatacaggatgtcaagtactgaccaaagtcctgagaactcggcagataataaaacagacaaaagcctttgccttcatgaagcatacattcattcaggggtagacacacaaaaaatgaaataaacaggtaaaatatgtagcatgtttgatggtgataattgttttggagaaaatacaacacggaagggtgagtcccatccttaattatcatcttatgcaaggaaatattccataacaataaacatcgctgtaaggatga

SEQ ID NO: 439147 - DNA, 642 bp, Homo sapiens
  misc_feature (601)..(601): n is a, c, g, or t
  misc_feature (604)..(604): n is a, c, g, or t
  misc_feature (635)..(635): n is a, c, g, or t
aggcttctgggatatgacagcattgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagatgcactgagcctctggtagcctttcaaccatgcattccatctaagctctgcaaaattgaagaggctgactgcaagaataaatttcgctgtgacagtgaagttttatgacctggaacccatctnacncatgtcacatcaggcctattcctaaacatcnctcaagg

SEQ ID NO: 439148 - DNA, 3589 bp, Homo sapiens
aggcttctgggatatgacagcattgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgagcctctggtagcctttcaaccatgcattccatctaagctctgcaaaattgaagaggctgactgcaagaataaatttcgctgtgacagtggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtttcattttctggcaggagagcccagaggagaagtccttgataactctttcactggaggaatatgtaaaactgtcaaaagcagtaggacaagtaatccataccgtgttccggccaatctggaaaatgtcggctttgaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaagaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtttaaccgaggaagaagccaaacactgtgtcaggattgaaacaaagaaacgcgttttatttgctaagaaagttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccaatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaatggacaaccatgtatcaatgatgatgaagaaatgaaagaggtcgatcttcctgagatagaagcagattccgggtgtcctcagccagttcctccagaaaatggatttatccggaatgaaaagcaactatacttggttggagaagatgttgaaatttcatgccttactggctttgaaactgttggataccagtacttcagatgcttaccagacgggacctggagacaaggggatgtggaatgccaacggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaagatactctaacaaaattaaaaggccattgtcagctgggacagaaacaatcaggatctgaatgcatttgtatgtctccagaagaagactgtagccatcattcagaagatctctgtgtgtttgacacagactccaacgattactttacttcacccgcttgtaagtttttggctgagaaatgtttaaataatcagcaactccattttctacatattggttcctgccaagacggccgccagttagaatggggtcttgaaaggacaagactttcatccaacagcacaaagaaagaatcctgtggctatgacacctgctatgactgggaaaaatgttcagcctccacttccaaatgtgtctgcctattgcccccacagtgcttcaagggtggaaaccaactctactgtgtcaaaatgggatcatcaacaagtgagaaaacattgaacatctgtgaagtgggaactataagatgtgcaaacaggaagatggaaatactgcatcctggaaagtgtttggcctagcacaattactgctaggcccagcacaatgaacagatttaccatcccgaagaaccaactcctacaaatgagaattcttgcacaaacagcagactggcatgctcaaagttactgacaaaaattattttctgttagtttgagatcattattctcccctgactctcctgtttgggcatgtcttattcagttccagctcatgacgccctgtagcatacccctaggtaccaacttccacagcagtctcgtaaattctcctgttcacattgtacaaaaataatgtgacttctgaggcccttatgtagcctgtgacattaagcattctcacaattagaaataagaataaaacccataattttcttcaatgagttaataaacagaaatctccagaacctctgaaacacattcttgaagcccagctttcatatcttcattcaacaaataatttctgagtgtgtatacaggatgtcaagtactgaccaaagtcctgagaactcggcagataataaaacagacaaaagcctttgccttcatgaagcatacattcattcaggggtagacacacaaaaaatgaaataaacaggtaaaatatgtagcatgtttgatggtgataattgttttggagaaaatacaacacggaagggtgagtcccatccttaattatcatcttatgcaaggaaatattccataacaataaacatcgctgtaaggatga

SEQ ID NO: 439149 - DNA, 3637 bp, Homo sapiens
aggcttctgggatatgacagcattgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgagcctctggtagcctttcaaccatgcattccatctaagctctgcaaaattgaagaggctgactgcaagaataaatttcgctgtgacagtggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtttcattttctggcaggagagcccagaggagaagtccttgataactctttcactggaggaatatgtaaaactgtcaaaagcagtaggacaagtaatccataccgtgttccggccaatctggaaaatgtcggctttgaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaaggattctagttttattaggatccataaagtgatgaaagtcttaaacttcacaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtttaaccgaggaagaagccaaacactgtgtcaggattgaaacaaagaaacgcgttttatttgctaagaaaacaaaagtggaacataggtgcaccaccaacaagctgtcagagaaacatgaaggttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccaatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaatggacaaccatgtatcaatgatgatgaagaaatgaaagaggtcgatcttcctgagatagaagcagattccgggtgtcctcagccagttcctccagaaaatggatttatccggaatgaaaagcaactatacttggttggagaagatgttgaaatttcatgccttactggctttgaaactgttggataccagtacttcagatgcttaccagacgggacctggagacaaggggatgtggaatgccaacggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaagatactctaacaaaattaaaaggccattgtcagctgggacagaaacaatcaggatctgaatgcatttgtatgtctccagaagaagactgtagccatcattcagaagatctctgtgtgtttgacacagactccaacgattactttacttcacccgcttgtaagtttttggctgagaaatgtttaaataatcagcaactccattttctacatattggttcctgccaagacggccgccagttagaatggggtcttgaaaggacaagactttcatccaacagcacaaagaaagaatcctgtggctatgacacctgctatgactgggaaaaatgttcagcctccacttccaaatgtgtctgcctattgcccccacagtgcttcaagggtggaaaccaactctactgtgtcaaaatgggatcatcaacaagtgagaaaacattgaacatctgtgaagtgggaactataagatgtgcaaacaggaagatggaaatactgcatcctggaaagtgtttggcctagcacaattactgctaggcccagcacaatgaacagatttaccatcccgaagaaccaactcctacaaatgagaattcttgcacaaacagcagactggcatgctcaaagttactgacaggcatgtcttattcagttccagctcatgacgccctgtagcatacccctaggtaccaacttccacagcagtctcgtaaattctcctgttcacattgtacaaaaataatgtgacttctgaggcccttatgtagcctgtgacattaagcattctcacaattagaaataagaataaaacccataattttcttcaatgagttaataaacagaaatctccagaacctctgaaacacattcttgaagcccagctttcatatcttcattcaacaaataatttctgagtgtgtatacaggatgtcaagtactgaccaaagtcctgagaactcggcagataataaaacagacaaaagcctttgccttcatgaagcatacattcattcaggggtagacacacaaaaaatgaaataaacaggtaaaatatgtagcatgtttgatggtgataattgttttggagaaaatacaacacggaagggtgagtcccatccttaattatcatcttatgcaaggaaatattccataacaataaacatcgctgtaaggatga

SEQ ID NO: 439150 - DNA, 1019 bp, Homo sapiens
aggcttctgggatatgacagcattgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgagcctctggtagcctttcaaccatgcattccatctaagctctgcaaaattgaagaggctgactgcaagaataaatttcgctgtgacagtggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtttcattttctggcaggagagcccagaggagaagtccttgataactctttcactggaggaatatgtaaaactgtcaaaagcagtaggacaagtaatccataccgtgttccggccaatctggaaaatgtcggctttgaggtatgacagcctagcatggtggcaactccaacaccgtcagtgattataagctaaatttctcatgcaaaattagtgatgaatgaagggacagaataaaaaggtggtgaaccatttta

SEQ ID NO: 439151 - DNA, 483 bp, Homo sapiens
aagttatgcgaaggaaaccaagccatctgcatgtttatttcctctgctcataataggaaaatggatgttatggagcttcaagaatcgagttacccaccagaaccctaatggtaaagctatgattttaggcatgctgtcaaatccctgctttcagaccctccttaacttcatattgtgagactgctcggtcaagtgccaggagattgtgattgggagagggtaaggcaaacagcgactgccagaaagaccttttgcaggatgtggaggcgtcctcaggagagttatttcgatttattctgaagcctgagttggagcagatccctttcttagcttatatcttcttcttgtaaaagtgcttttcaacctttctctcccgaacatcttccttctccaaagctgggagtcatgttgcctgcagggactctttccttactgggcccaggagttcgaggtgcagtttggcaacctgtgtcctggctgagg

SEQ ID NO: 439152 - DNA, 1288 bp, Homo sapiens
actcggcacgtcatcgccgcgcgccggcttgccaggagctggagggggaggtaggcggggcggcgcgtgacctaaggcctctctgccgcgcgcgcagagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggtatctagccagcaccagccctaccagaatgcatcacattcagggcaacacaccagcaggcacattggcccttgttgcactctttcgtgctcaagggcattcatcatgatttcatcagttttcttccccttgcaggtgggtcaagcagagcaatggcacacatcatcaccatggcacacacttgcacagccaaacctatgcacaaggccaagaggcacaggtcggcaactttatcccatagcatagcagtgcagacaaacgtcaaaccccacagtaggacaagattaggtagcagtagcaacaacaacattggcaagacgctcactaccgataccccagcatttccactggacatgagcgggcgcatcagacaggcaacaggggtcccaccaagacatcagccagccagcacacagcaccgataggcaatcacccaggtggcacacaacagaccaataaaccccataggacaattgacaacgccggaccatatgcaggggcaatggcaaacatggccacaaagaatacgcacatcgtggacccaacaccgttcataccccatcccaagacaagacaggagccaacaacgaatcacacagaaccgtactccgaagagatagagacagattaacaatgaaaaaagaaacatatgcaatggactcaggaataacccaaacagcattcacaatagagccacagacaaagacgcagaaaccacaacacagacagagcacgacatgcggacactattaagtacaaacacataaaccatgaacatgatccaacacacacccacaggacatagacaacacaaacacaagaggacagaacagacaaataggagacatacaacgagacttcgacaatgcgaaccgaaagaatgcagcacgcgagtataaactagctgaaacacaatcaaaagagaacacaacaccccagacacacatacaagcaacatgtgagaaccacaatgccaaaaaaaaacagcacaaaaatagcacgacacaacaaagagatagagacaaatcatagcat

SEQ ID NO: 439153 - DNA, 4065 bp, Homo sapiens
gcagatggtctaacggctggatagaggcatatttttagtttgaatttcctgcgcttacagaatggttttatctaatttgtagctactggggttctttattctctggggccacctgaaggctttcaaacacagtaataagccctcctcgggctgggaaacaggaagctgtgttttaaatgccgtgatcactggattaaaggaaacatggctccactctgttctcttgccaggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctgatgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacatattacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaatggcagcatttttttgtgacaaaggtaagggttaagacagtgtgtgtgtgtgtgtgtgtgtgtgtgtgtgtgtgtgtggggcgcgcgcgtaacgtgggcgcatccctcttttccttccctgggttcagtgtggcgtgggtaaggaccgtctgtgtgtagggctgccaggctgcagcctgctgctccagggagcaccagctgcagctgatccaatacaccaagcctgtgtctccctcttctatcacctctctccaggatctctgctgtctcttggatcccatctgcctagatggaagaggatcctatccgaagctaggataaatgttgtcttactcctctgctatgttctcccagaaaaaattgattacaagttctctgctgtggttgctgcagctccaggaagtccccgcaatgtctcacgttgtctttgaccagtggtccccagtaccaggccagagaagacaactttataatgtcatttgtgttgtgaaaattcttccactgacccaaaatggaaccgtacaaagcctatccgtgtatatggaaaagtctcatgcacctggattaactcagaaaaagtaaagtcctgaaacttcact

SEQ ID NO: 439154 - DNA, 3836 bp, Homo sapiens
actcggcacgtcatcgccgcgcgccggcttgccaggagctggagggggaggtaggcggggcggcgcgtgacctaaggcctctctgccgcgcgcgcagagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatactcaggaaaccagaggaatggatttgacttttctgctaggattctttgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctgatgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacatattacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctgga

SEQ ID NO: 439155 - DNA, 3745 bp, Homo sapiens
actcggcacgtcatcgccgcgcgccggcttgccaggagctggagggggaggtaggcggggcggcgcgtgacctaaggcctctctgccgcgcgcgcagagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatactcaggaaaccagaggaatggatttgacttttctgctaggattctttgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtgaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctgatgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacatattacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctgga

SEQ ID NO: 439156 - DNA, 3559 bp, Homo sapiens
gcagatggtctaacggctggatagaggcatatttttagtttgaatttcctgcgcttacagaatggttttatctaatttgtagctactggggttctttattctctggggccacctgaaggctttcaaacacagtaataagccctcctcgggctgggaaacaggaagctgtgttttaaatgccgtgatcactggattaaaggaaacatggctccactctgttctcttgccaggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagctttgagctacaccctgtccagctgttctgtacaaccctttccccttttctcccttcctgattgtgagcatgctgatgggtgggcatgatgcctcttgccctgcacaggtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctgatgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacatattacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctgga

SEQ ID NO: 439157 - DNA, 2996 bp, Homo sapiens
agctatacaggagacagctattaccaggagacatgtatagcaggaagacatgctgtatcaggaagataggatttatccaagtgtaaatacgatgtgacctgtatccctagtcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctgatgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacatattacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctgga

SEQ ID NO: 439158 - DNA, 2398 bp, Homo sapiens
ctcatagtctgatctcttgagtatccccggtaacccggctatctccatgaccatgtacaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctgatgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacatattacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctgga

SEQ ID NO: 439159 - DNA, 3621 bp, Homo sapiens
actcggcacgtcatcgccgcgcgccggcttgccaggagctggagggggaggtaggcggggcggcgcgtgacctaaggcctctctgccgcgcgcgcaggtacggggcagaagtcgcaggtacccagctgctgcccacatttctggtccagagtcccgaaccccgagcactgggatgcctggctactccgagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatactcaggaaaccagaggaatggatttgacttttctgctaggattctttgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctgatgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacatattacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggatctctgctgtctcttggatcccatctgcctagatggaagaggatcctatccgaagctaggataaatgttgtcttactcctctgctatgttctcccagaaaaaattgattacaagttctctgctgtggttgctgcagctccaggaagtccccgcaatgtctcacgttgtctttgaccagtggtccccagtaccaggccagagaagacaactttataatgtcatttgtgttgtgaaaattcttccactgacccaaaatggaaccgtacaaagcctatccgtgtatatggaaaagtctcatgcacctggattaactcagaaaaagtaaagtcctgaaacttcact

SEQ ID NO: 439160 - DNA, 1578 bp, Homo sapiens
actcggcacgtcatcgccgcgcgccggcttgccaggagctggagggggaggtaggcggggcggcgcgtgacctaaggcctctctgccgcgcgcgcaggtacggggcagaagtcgcaggtacccagctgctgcccacatttctggtccagagtcccgaaccccgagcactgggatgcctggctactccgagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatactcaggaaaccagaggaatggatttgacttttctgctaggattctttgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtaagttgaatggcagaatcagtgctgaagtgttgcaatgataagtttaggaagttatgttgtttctgagtcttgaatttagaattatctgcccccaccaacctcatccatgtactgtgtttagtaatcaccctcgcttcctgtggtactctctgcaggttttcatcatcaagtgctttccaaaacatttctaacatattctgcattgcacacagctggtttctcctttcctttcaaagacttaggccaacttgtggaaattctgtttactctgtgttgtaaattgagtttttatcatcatcttttcttctccatgctctctacacttactgggtaagtgacccagaaaaaaatgatagatatatgttaggttttagagaacccattaaaaaaaaaaaaagaatattgcttgagtccaggagttcgatatcagcctgggcaacatagtaagacccccgtctctataaaaaatttaaaaattaaccgggtgtggtggctcatgtctgtggtcttagctactggggaggctgaggggaggattgcttgagcttaggagtttcaggctgcagtgagccatgattgccactgcacgctagcctaggcaacagagtgacaccctgtcttaaaaaaaaaaaa

SEQ ID NO: 439161 - DNA, 4087 bp, Homo sapiens
  misc_feature (2213)..(2213): n is a, c, g, or t
  misc_feature (2293)..(2293): n is a, c, g, or t
  misc_feature (2759)..(2759): n is a, c, g, or t
  misc_feature (2820)..(2820): n is a, c, g, or t
  misc_feature (3080)..(3080): n is a, c, g, or t
actcggcacgtcatcgccgcgcgccggcttgccaggagctggagggggaggtaggcggggcggcgcgtgacctaaggcctctctgccgcgcgcgcaggtacggggcagaagtcgcaggtacccagctgctgcccacatttctggtccagagtcccgaaccccgagcactgggatgcctggctactccgagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatactcaggaaaccagaggaatggatttgacttttctgctaggattctttgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcaggtattgtaaagtccacccacctggctggacagcatcccccagagcactggtcactgagcctgaggctggagggatcaggagcagaggccgtggagcagttgtttcacttggtcttgtcaggaccccaagtcctccaatgtcattctcctcagtagtgaagccattggtgaggctgaaagaaaatgttttcttccacgagctaggcctggatagttgttttttcttcaaaccaaggaaatcttggttgaattcgacttcccataagaatttgatgtctctttatgtcaaagagatgttagacttttcagagacagactgtaaaggatgtgtctttagaaagatttagggggttgggcacggtggttcacacctgtaatcccagcactttgggtggctgaggtgggcagatcacttgaggtgaggagttcaagaccagcctggccaacatgatgaaacccatctctatttaaaatacaaaaattagctgggtgtggtggtgcacacctgtaaatcccagctacttgggaggctgaggcaggagaatcgcttgaacctggcaggcagaggttgaggtgagctgagatcgcgccactgcactccagcctgggtagcaagagtgagactctgtctcaaaaaataaaaataaaaataaaaaaataaggaaaacaaactcttctaaaatacttccattttatatttatttaattgtttttatattgaaaaaaaagccatgcatgctcattgagaataaaattgcccatctttgaactgtacagggatagccactgccagcatctggcatatctccttccagtcctttttttgttttgtgtatgaagctgtggtttccagcgtatcatgaggctgtctttttacangtattagtgaacaggcatgtaaaatgctggtagggctctattcagcctcctcagccactgtggctatgggtgtcaattcnagtagcctttctgggaaacactttgataatgagaacgttaaggatgccctttatttttttcctaataatttgacttctaggaatatatcttaaggaaataatgtaactgctgaaaaaaatttatactcaaaacttgatcacaacaagctttatgaaagtgaaaaatcagacaaaacttgaatgcttaaagtaggaggtggcaaattatggcctgtgggccacctgcctacaaatgaagttttatttggctgcttttgagctataatagcagaaccaagtaggtgggacagagaccatatgccctgcaaagccaaaaatatttactgtcttgtcttttgcacagaaagtttactaattactggtctaaggtaggtaaatgattaatttactcatatcacttaaaccttcataaaattttaatcagccgtttaaaatggccaaagatgttttagtggcaggaaatgcntgttactgttttaagcagaaatatgaaattttatatagtgtggcctcaaaagtataaaaantgcataggcttaaggaaaaaatacccaatattaatagtactagcttggggatgagggattgtatgtgattttttttttcaacgctttgtctagagtaaattgaggttaggcttagtaatctaaaacatagttttttaaaaatcaccaaaaaaggaagaacaccatatcattctaagattgaaagtcattttggctagaagagcagttcttgtttggtttggttttgttttggtgggttcttttggaaccctcagattganacgagagatgttttcatttttgagaaaatcatcaggttttaggccctgattgtgaaccagaacaaacgagagattgggtatagcattttgtttaagtcaaatcctttatcgtgagagtcacagtattttgacatttttattataatggaatttatgtgaattctacatcagggctgtggcagatgtgactgtattctagaatatgagttccccaaaggtgtaaaagagaacaggaatcctcaattttattcccagaagggagagagactgagaaaatcagaacgtagagtgtgatgtgagtttgggtggagctgctgccttgcagcctgtgtgggcccaggttcttgcttcatcccagccatagtgggagccagcagcttgggggagcttctgttccatctgcttggctcttagcatgtggttgggacaagctttctgggcctggctaagttttatgaacagatggcacagcaaattcctgatggttaggtcaagaggagaatgtggtgcccagcgccaacttctgtgtgtgtttgttttcagagactccctacgggagaggatgccccgcaggaacatggaaaatggatgttatggagcttcaagaatcgagttacccaccagaaccctaatggtaaagctatgattttaggcatgctgtcaaatccctgctttcagaccctccttaacttcatattgtgagactgctcggtcaagtgccaggagattgtgattgggagagggtaaggcaaacagcgactgccagaaagaccttttgcaggatgtggaggcgtcctcaggagagttatttcgatttattctgaagcctgagttggagcagatccctttcttagcttatatcttcttcttgtaaaagtgcttttcaacctttctctcccgaacatcttccttctccaaagctgggagtcatgttgcctgcagggactctttccttactgggcccaggagttcgaggtgcagtttggcaacctgtgtcctggctgagg

SEQ ID NO: 439162 - DNA, 450 bp, Homo sapiens
catttagtggtgtcagcagttctgagtatagagaggtagaatagtcccaagccatggcacagctttcactgtgtgacacattctccttttccaggctttgagctacaccctgtccagctgttctgtacaaccctttccccttttctcccttcctgattgtgagcatgctgatgggtgggcatgatgcctcttgccctgcacaggtggagcccctgttgttgctgaaggcagcccgcattctgcagacctgccagcgctcgcctcacattctcgctggctgcatcctctataaaggactgtgagtaactccagacccctttcttccagccccattcccttgctgcacaactgaccatcagccacctccagatcacagtggggagcccagtctctggccagttccaagtgggctggttcggcaaatatcaggtagtttagatttgactcagt

SEQ ID NO: 439163 - DNA, 6144 bp, Homo sapiens
  misc_feature (2142)..(2142): n is a, c, g, or t
  misc_feature (2222)..(2222): n is a, c, g, or t
  misc_feature (2688)..(2688): n is a, c, g, or t
  misc_feature (2749)..(2749): n is a, c, g, or t
  misc_feature (3009)..(3009): n is a, c, g, or t
actcggcacgtcatcgccgcgcgccggcttgccaggagctggagggggaggtaggcggggcggcgcgtgacctaaggcctctctgccgcgcgcgcaggtacggggcagaagtcgcagagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatactcaggaaaccagaggaatggatttgacttttctgctaggattctttgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcaggtattgtaaagtccacccacctggctggacagcatcccccagagcactggtcactgagcctgaggctggagggatcaggagcagaggccgtggagcagttgtttcacttggtcttgtcaggaccccaagtcctccaatgtcattctcctcagtagtgaagccattggtgaggctgaaagaaaatgttttcttccacgagctaggcctggatagttgttttttcttcaaaccaaggaaatcttggttgaattcgacttcccataagaatttgatgtctctttatgtcaaagagatgttagacttttcagagacagactgtaaaggatgtgtctttagaaagatttagggggttgggcacggtggttcacacctgtaatcccagcactttgggtggctgaggtgggcagatcacttgaggtgaggagttcaagaccagcctggccaacatgatgaaacccatctctatttaaaatacaaaaattagctgggtgtggtggtgcacacctgtaaatcccagctacttgggaggctgaggcaggagaatcgcttgaacctggcaggcagaggttgaggtgagctgagatcgcgccactgcactccagcctgggtagcaagagtgagactctgtctcaaaaaataaaaataaaaataaaaaaataaggaaaacaaactcttctaaaatacttccattttatatttatttaattgtttttatattgaaaaaaaagccatgcatgctcattgagaataaaattgcccatctttgaactgtacagggatagccactgccagcatctggcatatctccttccagtcctttttttgttttgtgtatgaagctgtggtttccagcgtatcatgaggctgtctttttacangtattagtgaacaggcatgtaaaatgctggtagggctctattcagcctcctcagccactgtggctatgggtgtcaattcnagtagcctttctgggaaacactttgataatgagaacgttaaggatgccctttatttttttcctaataatttgacttctaggaatatatcttaaggaaataatgtaactgctgaaaaaaatttatactcaaaacttgatcacaacaagctttatgaaagtgaaaaatcagacaaaacttgaatgcttaaagtaggaggtggcaaattatggcctgtgggccacctgcctacaaatgaagttttatttggctgcttttgagctataatagcagaaccaagtaggtgggacagagaccatatgccctgcaaagccaaaaatatttactgtcttgtcttttgcacagaaagtttactaattactggtctaaggtaggtaaatgattaatttactcatatcacttaaaccttcataaaattttaatcagccgtttaaaatggccaaagatgttttagtggcaggaaatgcntgttactgttttaagcagaaatatgaaattttatatagtgtggcctcaaaagtataaaaantgcataggcttaaggaaaaaatacccaatattaatagtactagcttggggatgagggattgtatgtgattttttttttcaacgctttgtctagagtaaattgaggttaggcttagtaatctaaaacatagttttttaaaaatcaccaaaaaaggaagaacaccatatcattctaagattgaaagtcattttggctagaagagcagttcttgtttggtttggttttgttttggtgggttcttttggaaccctcagattganacgagagatgttttcatttttgagaaaatcatcaggttttaggccctgattgtgaaccagaacaaacgagagattgggtatagcattttgtttaagtcaaatcctttatcgtgagagtcacagtattttgacatttttattataatggaatttatgtgaattctacatcagggctgtggcagatgtgactgtattctagaatatgagttccccaaaggtgtaaaagagaacaggaatcctcaattttattcccagaagggagagagactgagaaaatcagaacgtagagtgtgatgtgagtttgggtggagctgctgccttgcagcctgtgtgggcccaggttcttgcttcatcccagccatagtgggagccagcagcttgggggagcttctgttccatctgcttggctcttagcatgtggttgggacaagctttctgggcctggctaagttttatgaacagatggcacagcaaattcctgatggttaggtcaagaggagaatgtggtgcccagcgccaacttctgtgtgtgtttgttttcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctgatgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacatattacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctgga

SEQ ID NO: 439164 - DNA, 3927 bp, Homo sapiens
actcggcacgtcatcgccgcgcgccggcttgccaggagctggagggggaggtaggcggggcggcgcgtgacctaaggcctctctgccgcgcgcgcaggtacggggcagaagtcgcaggtacccagctgctgcccacatttctggtccagagtcccgaaccccgagcactgggatgcctggctactccgagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatactcaggaaaccagaggaatggatttgacttttctgctaggattctttgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctgatgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacatattacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctgga

SEQ ID NO: 439165 - DNA, 3981 bp, Homo sapiens
actcggcacgtcatcgccgcgcgccggcttgccaggagctggagggggaggtaggcggggcggcgcgtgacctaaggcctctctgccgcgcgcgcaggtacggggcagaagtcgcaggtacccagctgctgcccacatttctggtccagagtcccgaaccccgagcactgggatgcctggctactccgagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatactcaggaaaccagaggaatggatttgacttttctgctaggattctttgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggaaaatggatgttatggagcttcaagaatcgagttacccaccagaaccctaatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctgatgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacatattacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctgga

SEQ ID NO: 439166 - DNA, 3280 bp, Homo sapiens
taaggctaggtacgaggctgggtgtgtgctctacctccacagaggcaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctgatgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacatattacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctgga

SEQ ID NO: 439167 - DNA, 3873 bp, Homo sapiens
actcggcacgtcatcgccgcgcgccggcttgccaggagctggagggggaggtaggcggggcggcgcgtgacctaaggcctctctgccgcgcgcgcaggtacggggcagaagtcgcaggtacccagctgctgcccacatttctggtccagagtcccgaaccccgagcactgggatgcctggctactccgagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatactcaggaaaccagaggaatggatttgacttttctgctaggattctttgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctgatgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacatattacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctgga

SEQ ID NO: 439168 - DNA, 2883 bp, Homo sapiens
actcggcacgtcatcgccgcgcgccggcttgccaggagctggagggggaggtaggcggggcggcgcgtgacctaaggcctctctgccgcgcgcgcaggtacggggcagaagtcgcaggtacccagctgctgcccacatttctggtccagagtcccgaaccccgagcactgggatgcctggctactccgagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatactcaggaaaccagaggaatggatttgacttttctgctaggattctttgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagtaccacagcagcctggcttcactgaatgggctggaagtccacctgaaagagacgctgcccagggatgaggcagcctccacgagcagcacctacaacttcacatattacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctgga

SEQ ID NO: 439169 - DNA, 1607 bp, Homo sapiens
aggccttagtgattctatagctaaaatattagatgttttattttggggggagtggggaaatagcatagaccgtcatttaagccttcagacaattagtgactgtgttgtacaaaaaagatggcgaaagcctgatctagataccaaaattcacatgtcatccaacctagcttactcttattttttcgcttttggtaactttacttttcaggttcacatagtacgaccgcattcagagcttgctgatggcaaacctgccgcaggtggccaccccgcatgatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctgga

SEQ ID NO: 439170 - DNA, 5841 bp, Homo sapiens
aaacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccactttgacgcatcctgtggccaccccaacaagctcgggacatgaccatcttatgaaaatttcaagcagttcaagcactgtggctatccctggctacaccttcacaagcccggggatgaccaccaccctaccgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcgtcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtccagattcctcttgtaaaataacccactagtgcctgagctcagtgctgctggatgatgagggagatcaagaaaaagccacgtaagggactttatagatgaactagtggaatcccttcattctgcagtgagattgccgagacctgaagagggtaagtgacttgcccaaggtcagagccacttggtgacagagccaggatgagaacaaagattccatttgcaccatgccacactgctgtgttcacatgtgccttccgtccagagcagtcccgggcaggggtgaaactccagcaggtggctgggctggaaaggagggcagggctacatcctggctcggtgggatctgacgacctgaaagtccagctcccaagttttccttctcctaccccagcctcgtgtacccatcttcccaccctctatgttcttacccctccctacactcagtgtttgttcccacttactctgtcctggggcctctgggattagcacaggttattcataaccttgaaccccttgttctggattcggattttctcacatttgcttcgtgagatgggggcttaacccacacaggtctccgtgcgtgaaccaggtctgcttaggggacctgcgtgcaggtgaggagagaaggggacactcgagtccaggctggtatctcagggcagctgatgaggggtcagcaggaacactggcccattgcccctggcactccttgcagaggccacccacgatcttctttgggcttccatttccaccagggactaaaatctgctgtagctagtgagagcagcgtgttccttttgttgttcactgctcagctgatgggagtgattccctgagacccagtatgaaagagcagtggctgcaggagaggccttcccggggccccccatcagcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaagctatgtaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctaggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcaactctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttaaaaaaaaa

SEQ ID NO: 439171 - DNA, 1920 bp, Homo sapiens
  misc_feature (21)..(21): n is a, c, g, or t
  misc_feature (24)..(24): n is a, c, g, or t
  misc_feature (57)..(57): n is a, c, g, or t
  misc_feature (63)..(63): n is a, c, g, or t
  misc_feature (90)..(91): n is a, c, g, or t
gctgaattctctttgattganttncaagaggcctattttgctgtctccgtcccaaanccctgnctggtgaagtgtgacccaggatcaccnnaggaggaataatccagtctggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcaactctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttaaaaaaaaa

SEQ ID NO: 439172 - DNA, 1384 bp, Homo sapiens
aaacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccactttgacgcatcctgtggccaccccaacaagctcgggacatgaccatcttatgaaaatttcaagcagttcaagcactgtggctatccctggctacaccttcacaagcccggggatgaccaccaccctaccgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcaggcggacatagtcgtggatcactacaaggaggagaagtttgaggacaggtccccagccgccgagtgcctatcagagaaggagacggaggagctcatgcctggatgagaaatgtctccgcg

SEQ ID NO: 439173 - DNA, 5892 bp, Homo sapiens
aaacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccactttgacgcatcctgtggccaccccaacaagctcgggacatgaccatcttatgaaaatttcaagcagttcaagcactgtggctatccctggctacaccttcacaagcccggggatgaccaccaccctaccgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcgtcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtccagattcctcttgtaaaataacccactagtgcctgagctcagtgctgctggatgatgagggagatcaagaaaaagccacgtaagggactttatagatgaactagtggaatcccttcattctgcagtgagattgccgagacctgaagagggtaagtgacttgcccaaggtcagagccacttggtgacagagccaggatgagaacaaagattccatttgcaccatgccacactgctgtgttcacatgtgccttccgtccagagcagtcccgggcaggggtgaaactccagcaggtggctgggctggaaaggagggcagggctacatcctggctcggtgggatctgacgacctgaaagtccagctcccaagttttccttctcctaccccagcctcgtgtacccatcttcccaccctctatgttcttacccctccctacactcagtgtttgttcccacttactctgtcctggggcctctgggattagcacaggttattcataaccttgaaccccttgttctggattcggattttctcacatttgcttcgtgagatgggggcttaacccacacaggtctccgtgcgtgaaccaggtctgcttaggggacctgcgtgcaggtgaggagagaaggggacactcgagtccaggctggtatctcagggcagctgatgaggggtcagcaggaacactggcccattgcccctggcactccttgcagaggccacccacgatcttctttgggcttccatttccaccagggactaaaatctgctgtagctagtgagagcagcgtgttccttttgttgttcactgctcagctgatgggagtgattccctgagacccagtatgaaagagcagtggctgcaggagaggccttcccggggccccccatcagcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaagctatgtctattccccaatataggacttttatgggctcggcagttagctgccatgtagaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctaggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcaactctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttaaaaaaaaa

SEQ ID NO: 439174 - DNA, 1482 bp, Homo sapiens
aaacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccactttgacgcatcctgtggccaccccaacaagctcgggacatgaccatcttatgaaaatttcaagcagttcaagcactgtggctatccctggctacaccttcacaagcccggggatgaccaccaccctaccgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccagctctacggccccttcctcccaggagacagtgcagcccacgagcccggcaacggcacttcagaacacctaccctgccagagaccatgagctccagccccacagcagcatcaactacccaccagataccccaaaacaccttctcccgtgccgcagagccggtgc

SEQ ID NO: 439175 - DNA, 219 bp, Homo sapiens
tcatcttttctcattaccctcgttttcccaatgacagcgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgatacccc

SEQ ID NO: 439176 - DNA, 2435 bp, Homo sapiens
gaaaccatggtcaggtggtctcttacctgttaaaatcaggagctgacaaagaaaagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacagagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439177 - DNA, 2471 bp, Homo sapiens
gaaaccatggtcaggtggtctcttacctgttaaaatcaggagctgacaaagaaaagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatgga

SEQ ID NO: 439178 - DNA, 1002 bp, Homo sapiens
attctcctgcctcagcctcccaagtaggtgggattacaggcatgcgccgtcacgcctggctcctttttttatatttttaatagagatggggtttcaccatgttggtcaggcaggtcttaatctcctgacctcaagtgatccatctgcctcgtcctcccaaagtgctgggattacaggcgtatgccaccgtgcctggcctgagttactgtcttttgcaaaatgcttatgtttctcataataatttttaaattgatagaacctaatgattcagaatgtaaaatacaggttaggaatggggctcaaagattcttacttcaccaaatctaggactataatactttctctgtaacaagcatcttcagtggaacaagggtccctacagccagctggggaaacactggctcatgggccttgccagcagaggacacagataaatctgtgtgcagcccctgtaaagaggaggctccttgaggacacaggagagcagtgcagcatgtcctgggctgatgcctgcagagtcttttgtaaggcagggacagttgggacactgtgaagaactactttagagcaatgacgaagataacaatttcatgctaagttaatcactgttgtccccctcccttaaaaacagatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439179 - DNA, 1193 bp, Homo sapiens
aatttttgtatttttagtagagactgggtttcaccgttggccaggcgggtctcaaactcctcgtctcaggtgatctgcttgcctcggcctcccaaagtgctgggattacaggcgtgagccactgcgcccagcctgagtttcattttttaagtcacatagcagtagtccttatttcagtgctagaccctttgaaatgcgatgaaagctatatggacccttcgctttgttatataacatatgcacacatacccagaattttgcacatatgttcagagattcctagacctgcagacctgcctctgtgtgtcccaatttaagaacctctgttctttcttcatgactggatttgcccaattttgtgttattttgggacttaatttgtccctctttgggacatttccttatttattgccctcttcagagagtagatgtagaaaataaagagaggaaacctagattacttaatttttattttaacattttctatagatagcataccacgccaagtgtgctctgtcttgatccccttctttctagcatctgccagacattgtagagtttcgcaagcagttgtaggtttgagctgcagccagtcatttcttttattctttaaaagtacatagatttgtctttttagggctttactgaaagtaaaatatcctgacatttaaactgacagatgtaggaggtaaaaaatagagttctgaaacatttgaatttatgtgacagctgaagtcacgagatgagggatgtatgtcccccagggaggatgcagaaagaagaaaagggtactggaaacagcatgtcagtggtgccagctgagggctggaggcagccaggagagttgggagcctgggtgctgggtggagagaggttaacagggaagacatgggaagtattgtgaaggctggtgtgagcaggggactactccagccctgttggaacatagagccatttggcagattgacaatgcagtgacagctgtatataataaatgtgttgaaaggaggaaggtgaggattttcttggtgggagtttatgctgttatttaacatattttgcttccaaggggttaagatgttttacctaaatggaggtttctaggtcagtgctatacaatatttctaatctgtgttttatagtgtgagctacatatgtaattttaaaattttcaagtagccacataataaagg

SEQ ID NO: 439180 - DNA, 323 bp, Homo sapiens
atattgtcgacccacgcgtccgcaaaaaataaatgactggaccccctgtgtagaaccaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439181 - DNA, 452 bp, Homo sapiens
gaatgtaatgatgcattttttaaaataccagagcaaatactttgttttatctttgccgatgaaactgtagtacatggctagaaaccttgcaaagagaaggctttacagtgtgtgatctgtctgtattaggtggttgtctggggtgagtgcgactccactgatgactgtattgagcacaacattggcccctgctcctcagtcctggacgtgggtggggctgtgacagctgtcagcgtctgcccagtgctccacccttctcaacggtcagtctctgtgtggggcttagttttaagaggaccacttggtttcttaatatgtagccctcatgtcatttcatttgtgaattctcctagcctctgagttactgtcttttttttctttttttttttttggtttgagatggagtctcactctgtcgcccaggctggaatgcagtggcgtgatctctgctc

SEQ ID NO: 439182 - DNA, 2618 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439183 - DNA, 2560 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439184 - DNA, 2593 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439185 - DNA, 2039 bp, Homo sapiens
  misc_feature (24)..(24): n is a, c, g, or t
  misc_feature (28)..(28): n is a, c, g, or t
aacggctaggtagaggctgggtgntganttgtcacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439186 - DNA, 2569 bp, Homo sapiens
  misc_feature (2534)..(2534): n is a, c, g, or t
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggaaaaaccaaaaangataatacttaatgttattattattaaaaaaaaaa

SEQ ID NO: 439187 - DNA, 1476 bp, Homo sapiens
tatgagcacttccattgcagagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439188 - DNA, 2470 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatgga

SEQ ID NO: 439189 - DNA, 3202 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcggtaaaacagcttctgattgggaaagttattagtgaaacagttatgtccattttatctacattaagcagctttagttaagagaaagataacagagtgaagggtagagcctcatgtctttgaagcctttcaaagttcgtggataactgaggaagacttgaccttccttgtaagatttaaatggagatgatctttatttgggttgacctacttgtgattatgtagtcaagatggcatgcattcagatatctcagttcaagaaacataaacatctgtatgtaggaagttaggttttgcaaatggtgatagaatgctaccacaaaacctaatggataacttatcctaagctaggattttatgggacaggaataatgaagatacaactaagaaaactcatggttgagtggtttcttctctctgaactattttattaatatagtactattttaaattatgaaatgtagaggaaaccattatccttagctttttcctaccctctccagtcacctccttcattgagaagggcatattaggcatccatctggataaatgacccctgagcaaggtgttagcccacctacccacattctactctgaacctggcataaactgaaaaaaaaaaaaagaggactaaaaacctttgtgtagttgggtcagtggcctattcctgttcccccagattcttttggtggataagttctagagagtgtttaaagtatatttgcattgtttaatcctgttttaaatttttccattgataagactcgcatacagtttggttttgtgatatttctggtctctttgtttcttgtgttttagagaacacccagggactgtaaagtatactcagcaatatgttttagaacagactgttttcttttgcatcactaatcttttcctaacatgcagcatttactgtttaaaaagctaaagtccaccaggcacagtggctcatgcgtgtgatcccaaatgctgggattacaggcatgagccaccgcgcccagcccaaaagctgattagttcttaagcattttgtggtagcttcttggggaagtgcatgagcctactgatgggactccactggatcagaaccaatttgtgagtatagaaggcatgttagacacctctctgtggtctctgggcaggaacgctttgtctttggaccaaggtgagctctcggagacgcatgtctgctgtaccgtgccttctttctg

SEQ ID NO: 439190 - DNA, 2165 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtttgtctgggttgacgcgactccaccaggtcttaacgacaccacatgtatc

SEQ ID NO: 439191 - DNA, 2102 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439192 - DNA, 2006 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatgga

SEQ ID NO: 439193 - DNA, 263 bp, Homo sapiens
ctttttgccttcaccaacaaaattacttctgtgcacagtagaattatttggtcttgtgattggagtcctgacagcaagtatttcttcactgggagtcgagacaaaaaggtaattatttaaaaatttaatattttttcaaatgtaaaaataatatttttataggtatgtttgaataaaaaatgcataatcctgcctttctgttacagcttttaaaaatcagctatgtattcctttctgtttttcgtatatgtacatataaaaaa

SEQ ID NO: 439194 - DNA, 2522 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatgga

SEQ ID NO: 439195 - DNA, 2813 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgttacctggaagactggccaggtggaacgaggcagggcctggaagccaccagcctctctcgccctctgtagcaggagctgcgactctatggtttcatgttacgcttccattctgtgcaaggctctgtggaaggagaagctgcacacattctggcatcataacagaatttcatttcttccatctgcattcaggccaataccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439196 - DNA, 2566 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439197 - DNA, 2979 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggaaaaaaaaaaaaaaaaaaaaaaaaaaaaaaaaaacaaacaaaaaaaaaaaaaaaaaaaaaaaaaaaaaaaaaaaaacgggggggcgccacaaaaaaacccccgcgggggggcacaatgacataagcggaaacaacaagattctagacaagaaaggggggccccaaataaggagaaggatatataaaagaagaaagaagcggggcgaacatctaaaaaacacgccggcgggaggaaaaacaacacgaaccggaggctaccctctgtggggaaaacacaccacactggcgacgaggaaacacaagggaccaagcagccgacagaaaatagacaccgccgccagataacaaacactacagggcgtaacgcgaacaaccagacgacagatcggagagcaaaacctcgcacccgagagaaacgcagacacagtatcccgaacgacacaaacacagccggacgg

SEQ ID NO: 439198 - DNA, 3997 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcggtaaaacagcttctgattgggaaagttattagtgaaacagttatgtccattttatctacattaagcagctttagttaagagaaagataacagagtgaagggtagagcctcatgtctttgaagcctttcaaagttcgtggataactgaggaagacttgaccttccttgtaagatttaaatggagatgatctttatttgggttgacctacttgtgattatgtagtcaagatggcatgcattcagatatctcagttcaagaaacataaacatctgtatgtaggaagttaggttttgcaaatggtgatagaatgctaccacaaaacctaatggataacttatcctaagctaggattttatgggacaggaataatgaagatacaactaagaaaactcatggttgagtggtttcttctctctgaactattttattaatatagtactattttaaattatgaaatgtagaggaaaccattatccttagctttttcctaccctctccagtcacctccttcattgagaagggcatattaggcatccatctggataaatgacccctgagcaaggtgttagcccacctacccacattctactctgaacctggcataaactgaaaaaaaaaaaaagaggactaaaaacctttgtgtagttgggtcagtggcctattcctgttcccccagattcttttggtggataagttctagagagtgtttaaagtatatttgcattgtttaatcctgttttaaatttttccattgataagactcgcatacagtttggttttgtgatatttctggtctctttgtttcttgtgttttagagaacacccagggactgtaaagtatactcagcaatatgttttagaacagactgttttcttttgcatcactaatcttttcctaacatgcagcatttactgtttaaaaagctaaagtccactgcgcccagcctgagtttcattttttaagtcacatagcagtagtccttatttcagtgctagaccctttgaaatgcgatgaaagctatatggacccttcgctttgttatataacatatgcacacatacccagaattttgcacatatgttcagagattcctagacctgcagacctgcctctgtgtgtcccaatttaagaacctctgttctttcttcatgactggatttgcccaattttgtgttattttgggacttaatttgtccctctttgggacatttccttatttattgccctcttcagagagtagatgtagaaaataaagagaggaaacctagattacttaatttttattttaacattttctatagatagcataccacgccaagtgtgctctgtcttgatccccttctttctagcatctgccagacattgtagagtttcgcaagcagttgtaggtttgagctgcagccagtcatttcttttattctttaaaagtacatagatttgtctttttagggctttactgaaagtaaaatatcctgacatttaaactgacagatgtaggaggtaaaaaatagagttctgaaacatttgaatttatgtgacagctgaagtcacgagatgagggatgtatgtcccccagggaggatgcagaaagaagaaaagggtactggaaacagcatgtcagtggtgccagctgagggctggaggcagccaggagagttgggagcctgggtgctgggtggagagaggttaacagggaagacatgggaagtattgtgaaggctggtgtgagcaggggactactccagccctgttggaacatagagccatttggcagattgacaatgcagtgacagctgtatataataaatgtgttgaaaggaggaaggtgaggattttcttggtgggagtttatgctgttatttaacatattttgcttccaaggggttaagatgttttacctaaatggaggtttctaggtcagtgctatacaatatttctaatctgtgttttatagtgtgagctacatatgtaattttaaaattttcaagtagccacataataaagg

SEQ ID NO: 439199 - DNA, 2484 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaagatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439200 - DNA, 2388 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaagatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatgga

SEQ ID NO: 439201 - DNA, 1183 bp, Homo sapiens
gtggcgacctagaggatcccttagctgtgtattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439202 - DNA, 1218 bp, Homo sapiens
gcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttt

SEQ ID NO: 439203 - DNA, 1903 bp, Homo sapiens
agagcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggctaaaaaaaaaagtcgacgcggcccgaaatttttttagttatgta

SEQ ID NO: 439204 - DNA, 2049 bp, Homo sapiens
aggtagaagataaggtgctgagttatctagtggctgtggcacaggaacattaagaggacaatgacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtgctccttcctgcttccacccagtgactgctgccatctcctgaccccagagtgggcctggatacagacatgaggaaggtgggggtcaggtgtcacgtcccccagtgttgcatggcagctgtccccatcccgggctcgcagtgccatagtgcaattcgccaagtgactgagggtgggggaagcctcttgcccaccctttcccccatcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggctaaaaaaaaaagtcgacgcggcccgaaatttttttagttatgta

SEQ ID NO: 439205 - DNA, 1703 bp, Homo sapiens
agagcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggctaaaaaaaaaagtcgacgcggcccgaaatttttttagttatgta

SEQ ID NO: 439206 - DNA, 1897 bp, Homo sapiens
ggtcccagggaagcagggaaggcggagagagaacacttccattccagttacagttccactgaattggaagctgtaactaccacttaggcatttttggcttctcataccactgcaccagcagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggctaaaaaaaaaagtcgacgcggcccgaaatttttttagttatgta

SEQ ID NO: 439207 - DNA, 1995 bp, Homo sapiens
aggtagaagataaggtgctgagttatctagtggctgtggcacaggaacattaagaggacaatgacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtgctccttcctgcttccacccagtgactgctgccatctcctgaccccagagtgggcctggatacagacatgaggaaggtgggggtcaggtgtcacgtcccccagtgttgcatggcagctgtccccatcccgggctcgcagtgccatagtgcaattcgccaagtgactgagggtgggggaagcctcttgcccaccctttcccccatcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggctaaaaaaaaaagtcgacgcggcccgaaatttttttagttatgta

SEQ ID NO: 439208 - DNA, 1176 bp, Homo sapiens
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgca

SEQ ID NO: 439209 - DNA, 154 bp, Homo sapiens
aattcaagcttctaacgatgtacggggacatgcgaccccacgccaccccgtgcctcctgcctccgcgcagcctgcagcgggagaccctgtccccgccccagccgtcctcctggggtggaccctagtttaataaagattcaccaagtttcacgca

SEQ ID NO: 439210 - DNA, 616 bp, Homo sapiens
  misc_feature (48)..(48): n is a, c, g, or t
  misc_feature (59)..(59): n is a, c, g, or t
  misc_feature (63)..(63): n is a, c, g, or t
  misc_feature (82)..(82): n is a, c, g, or t
  misc_feature (87)..(87): n is a, c, g, or t
  misc_feature (93)..(93): n is a, c, g, or t
cccgtgcgtaagcggctcctccgcgatgccgatgacctgcagaagagncctcgggtttntttnataatggcggggagacggnggggngggggngggggttttcctttatcacaccgtcggcgatttccggggaaagagcgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgc

SEQ ID NO: 439211 - DNA, 689 bp, Homo sapiens
  misc_feature (8)..(8): n is a, c, g, or t
agcggctnctcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagcgcctggcacggaccatgaccgttaccgcgaggtcatcgagcgcgagctagcggcatgcccgagcgcctggggcccctgatgcagggcc

SEQ ID NO: 439212 - DNA, 464 bp, Homo sapiens
  misc_feature (74)..(74): n is a, c, g, or t
  misc_feature (76)..(76): n is a, c, g, or t
agcagcggagtccctacgtcaggccccaccggtatcgtgacatgagacgtgcttcctcaggagactcgactggncnggactacccacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggagggcgctgatggacgagaccatgaaggagttgaaggcctacaaatcggaactggaggaacaactttggactttgggccctgtttggactttgggccctgtttggactctgggccctgtttggactctg

SEQ ID NO: 439213 - DNA, 799 bp, Homo sapiens
tcgatggagagcggatccacagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcggcgcagcctgcagcgggagaccctgtccccgccccagccgtcctcctggggtggaccctagtttaataaagattcaccaagtttcacgca

SEQ ID NO: 439214 - DNA, 651 bp, Homo sapiens
  misc_feature (74)..(74): n is a, c, g, or t
  misc_feature (76)..(76): n is a, c, g, or t
agcagcggagtccctacgtcaggccccaccggtatcgtgacatgagacgtgcttcctcaggagactcgactggncnggactacccacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattaccttgggattacctgcgctgggtgcagacactgtctgagcaggtgcaggaggagctgctcagctcccaggtcacccaggaactgagggagggcgctgatggacgagaccatgaaggagttgaaggcctacaaatcggaactggaggaacaactgaccccggtggcggcgttggatgcagtcaacgagggaaggaggcggggttggatgcagtcgactgcatccaaagccgcgtgactgcatccaacgccgcaggtgtcctaaggcgagctcagggaggacagaaacctcccgtggagcagaagggcaaaagctcggttgatcttgattttcagtacgaatacagaccgtgaaagcggggctcacgatccttctgagcttttgggttttaagca

SEQ ID NO: 439215 - DNA, 291 bp, Homo sapiens
ggagcgacaggaagagcctcatggcgaggccggaggggcactctgaatccttgctggagggcttggttgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439216 - DNA, 422 bp, Homo sapiens
cccgcagctcagccacggcacagatcagcaccagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439217 - DNA, 6695 bp, Homo sapiens
  misc_feature (2098)..(2098): n is a, c, g, or t
  misc_feature (2955)..(2955): n is a, c, g, or t
  misc_feature (3993)..(3993): n is a, c, g, or t
  misc_feature (4215)..(4215): n is a, c, g, or t
  misc_feature (4436)..(4436): n is a, c, g, or t
  misc_feature (4679)..(4679): n is a, c, g, or t
  misc_feature (4979)..(4979): n is a, c, g, or t
  misc_feature (5010)..(5010): n is a, c, g, or t
  misc_feature (5295)..(5295): n is a, c, g, or t
  misc_feature (5343)..(5343): n is a, c, g, or t
  misc_feature (5350)..(5350): n is a, c, g, or t
  misc_feature (5696)..(5696): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagagcctgataaaggtcctgcgggcaggacaggacctcccaaccaagccctccagcaaggattcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439218 - DNA, 7247 bp, Homo sapiens
  misc_feature (2098)..(2098): n is a, c, g, or t
  misc_feature (2955)..(2955): n is a, c, g, or t
  misc_feature (3993)..(3993): n is a, c, g, or t
  misc_feature (4215)..(4215): n is a, c, g, or t
  misc_feature (4436)..(4436): n is a, c, g, or t
  misc_feature (4679)..(4679): n is a, c, g, or t
  misc_feature (4979)..(4979): n is a, c, g, or t
  misc_feature (5010)..(5010): n is a, c, g, or t
  misc_feature (5295)..(5295): n is a, c, g, or t
  misc_feature (5343)..(5343): n is a, c, g, or t
  misc_feature (5350)..(5350): n is a, c, g, or t
  misc_feature (5696)..(5696): n is a, c, g, or t
  misc_feature (6573)..(6573): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggangtagggagggaggagggtgccactgatcccctgaacccctgcctctgcctcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaaaaaaaaaaaaaaaaaaaaaaaaaaaaacaaaaaaaaaaaaaaaaaaaaaaaaaaaaaaaaaaaaatacaaaaataaaaaaaaagaaagagccaaatagaaaaaaaacagatcacccaaacacatggaccgacaaacagataacaaaactgctggggggggcccacacccacatacccctttacggagccagataaaaaatcaaagaccggtggtttaaaccctgaagaagggt

SEQ ID NO: 439219 - DNA, 6957 bp, Homo sapiens
  misc_feature (2098)..(2098): n is a, c, g, or t
  misc_feature (2955)..(2955): n is a, c, g, or t
  misc_feature (3993)..(3993): n is a, c, g, or t
  misc_feature (4215)..(4215): n is a, c, g, or t
  misc_feature (4436)..(4436): n is a, c, g, or t
  misc_feature (4679)..(4679): n is a, c, g, or t
  misc_feature (4979)..(4979): n is a, c, g, or t
  misc_feature (5010)..(5010): n is a, c, g, or t
  misc_feature (5295)..(5295): n is a, c, g, or t
  misc_feature (5343)..(5343): n is a, c, g, or t
  misc_feature (5350)..(5350): n is a, c, g, or t
  misc_feature (5696)..(5696): n is a, c, g, or t
  misc_feature (6731)..(6732): n is a, c, g, or t
  misc_feature (6750)..(6750): n is a, c, g, or t
  misc_feature (6754)..(6754): n is a, c, g, or t
  misc_feature (6765)..(6765): n is a, c, g, or t
  misc_feature (6769)..(6769): n is a, c, g, or t
  misc_feature (6772)..(6773): n is a, c, g, or t
  misc_feature (6775)..(6775): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagagcctgataaaggtcctgcgggcaggacaggacctcccaaccaagccctccagcaaggattcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaaaaaaaaaaaaaaaaaaaaaaaaaaaaacaaaaaaanntgtgtgtggggcgcgccngggnccctggaaaanagtnttnnanaaacccttcgcgtgttggggcgcgcgggggccccaggagggggatacggtgcgaccctggggggccaacagccgggggtccacaagggagaacccgggcgcacagagagaaaaagcgggcggggagattccccacccaagttaaaaaacgcgccggggggggacccccggaggcgtctcagg

SEQ ID NO: 439220 - DNA, 1318 bp, Homo sapiens
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcaaaaaaaaaaaaaaaaaaaaaaaacttcgcgggcctcatatgccgggggcgggaaagcgtttttaatggcctgggcatagggtttcctgaccattttttttcagggggactggcgccccaagggggggataatgaagcggtcg

SEQ ID NO: 439221 - DNA, 6559 bp, Homo sapiens
  misc_feature (2098)..(2098): n is a, c, g, or t
  misc_feature (2955)..(2955): n is a, c, g, or t
  misc_feature (3993)..(3993): n is a, c, g, or t
  misc_feature (4215)..(4215): n is a, c, g, or t
  misc_feature (4436)..(4436): n is a, c, g, or t
  misc_feature (4679)..(4679): n is a, c, g, or t
  misc_feature (4979)..(4979): n is a, c, g, or t
  misc_feature (5010)..(5010): n is a, c, g, or t
  misc_feature (5295)..(5295): n is a, c, g, or t
  misc_feature (5343)..(5343): n is a, c, g, or t
  misc_feature (5350)..(5350): n is a, c, g, or t
  misc_feature (5696)..(5696): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagagcctgataaaggtcctgcgggcaggacaggacctcccaaccaagccctccagcaaggattcagagtgcccctccggcctcgccatgaggctcttcctgtcgctcccggtcctggtggtggttctgtcgatcgtcttggaagggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439222 - DNA, 6571 bp, Homo sapiens
  misc_feature (2098)..(2098): n is a, c, g, or t
  misc_feature (2955)..(2955): n is a, c, g, or t
  misc_feature (3993)..(3993): n is a, c, g, or t
  misc_feature (4215)..(4215): n is a, c, g, or t
  misc_feature (4436)..(4436): n is a, c, g, or t
  misc_feature (4679)..(4679): n is a, c, g, or t
  misc_feature (4979)..(4979): n is a, c, g, or t
  misc_feature (5010)..(5010): n is a, c, g, or t
  misc_feature (5295)..(5295): n is a, c, g, or t
  misc_feature (5343)..(5343): n is a, c, g, or t
  misc_feature (5350)..(5350): n is a, c, g, or t
  misc_feature (5696)..(5696): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggatttctgaaatttcccacaccccagcgcctgtgctgaggactccctccatgtggccccaggtgccaccaataaaaatcctacagaaaa

SEQ ID NO: 439223 - DNA, 1288 bp, Homo sapiens
agcgggagccctataattggacaagtctgggagcggagtcctactcagccccagcggaggtgaaggacgtccttccccaggagccggtgagaagcgcagtcgggggcacggggatgagctcaggggcctctagaaagagctgggaccctgggaagccctggcctccagactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgca

SEQ ID NO: 439224 - DNA, 7042 bp, Homo sapiens
  misc_feature (2126)..(2126): n is a, c, g, or t
  misc_feature (2983)..(2983): n is a, c, g, or t
  misc_feature (4021)..(4021): n is a, c, g, or t
  misc_feature (4243)..(4243): n is a, c, g, or t
  misc_feature (4464)..(4464): n is a, c, g, or t
  misc_feature (4707)..(4707): n is a, c, g, or t
  misc_feature (5007)..(5007): n is a, c, g, or t
  misc_feature (5038)..(5038): n is a, c, g, or t
  misc_feature (5323)..(5323): n is a, c, g, or t
  misc_feature (5371)..(5371): n is a, c, g, or t
  misc_feature (5378)..(5378): n is a, c, g, or t
  misc_feature (5724)..(5724): n is a, c, g, or t
  misc_feature (6601)..(6601): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggagcccggccccccccaaaaaaagggctggagagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggangtagggagggaggagggtgccactgatcccctgaacccctgcctctgcctcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439225 - DNA, 6981 bp, Homo sapiens
  misc_feature (2065)..(2065): n is a, c, g, or t
  misc_feature (2922)..(2922): n is a, c, g, or t
  misc_feature (3960)..(3960): n is a, c, g, or t
  misc_feature (4182)..(4182): n is a, c, g, or t
  misc_feature (4403)..(4403): n is a, c, g, or t
  misc_feature (4646)..(4646): n is a, c, g, or t
  misc_feature (4946)..(4946): n is a, c, g, or t
  misc_feature (4977)..(4977): n is a, c, g, or t
  misc_feature (5262)..(5262): n is a, c, g, or t
  misc_feature (5310)..(5310): n is a, c, g, or t
  misc_feature (5317)..(5317): n is a, c, g, or t
  misc_feature (5663)..(5663): n is a, c, g, or t
  misc_feature (6540)..(6540): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggangtagggagggaggagggtgccactgatcccctgaacccctgcctctgcctcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439226 - DNA, 1143 bp, Homo sapiens
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgca

SEQ ID NO: 439227 - DNA, 1042 bp, Homo sapiens
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgca

SEQ ID NO: 439228 - DNA, 7011 bp, Homo sapiens
  misc_feature (2095)..(2095): n is a, c, g, or t
  misc_feature (2952)..(2952): n is a, c, g, or t
  misc_feature (3990)..(3990): n is a, c, g, or t
  misc_feature (4212)..(4212): n is a, c, g, or t
  misc_feature (4433)..(4433): n is a, c, g, or t
  misc_feature (4676)..(4676): n is a, c, g, or t
  misc_feature (4976)..(4976): n is a, c, g, or t
  misc_feature (5007)..(5007): n is a, c, g, or t
  misc_feature (5292)..(5292): n is a, c, g, or t
  misc_feature (5340)..(5340): n is a, c, g, or t
  misc_feature (5347)..(5347): n is a, c, g, or t
  misc_feature (5693)..(5693): n is a, c, g, or t
  misc_feature (6570)..(6570): n is a, c, g, or t
agcgggagccctataattggacaagtctgggagcggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggangtagggagggaggagggtgccactgatcccctgaacccctgcctctgcctcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439229 - DNA, 6811 bp, Homo sapiens
  misc_feature (1895)..(1895): n is a, c, g, or t
  misc_feature (2752)..(2752): n is a, c, g, or t
  misc_feature (3790)..(3790): n is a, c, g, or t
  misc_feature (4012)..(4012): n is a, c, g, or t
  misc_feature (4233)..(4233): n is a, c, g, or t
  misc_feature (4476)..(4476): n is a, c, g, or t
  misc_feature (4776)..(4776): n is a, c, g, or t
  misc_feature (4807)..(4807): n is a, c, g, or t
  misc_feature (5092)..(5092): n is a, c, g, or t
  misc_feature (5140)..(5140): n is a, c, g, or t
  misc_feature (5147)..(5147): n is a, c, g, or t
  misc_feature (5493)..(5493): n is a, c, g, or t
  misc_feature (6370)..(6370): n is a, c, g, or t
agcggacacagcccctccggatcgtcctagacgtccttccccatgagagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggangtagggagggaggagggtgccactgatcccctgaacccctgcctctgcctcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439230 - DNA, 6399 bp, Homo sapiens
  misc_feature (1483)..(1483): n is a, c, g, or t
  misc_feature (2340)..(2340): n is a, c, g, or t
  misc_feature (3378)..(3378): n is a, c, g, or t
  misc_feature (3600)..(3600): n is a, c, g, or t
  misc_feature (3821)..(3821): n is a, c, g, or t
  misc_feature (4064)..(4064): n is a, c, g, or t
  misc_feature (4364)..(4364): n is a, c, g, or t
  misc_feature (4395)..(4395): n is a, c, g, or t
  misc_feature (4680)..(4680): n is a, c, g, or t
  misc_feature (4728)..(4728): n is a, c, g, or t
  misc_feature (4735)..(4735): n is a, c, g, or t
  misc_feature (5081)..(5081): n is a, c, g, or t
  misc_feature (5958)..(5958): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggangtagggagggaggagggtgccactgatcccctgaacccctgcctctgcctcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439231 - DNA, 591 bp, Homo sapiens
agttatacggggaccggcccaaaattgctattccccgagaaaaggggtggtggtgtttttcaagcacggagccccccgtggggggcgtagtgtggcctccagttgccacccttgaagggttcttgggcccctggttgttacaagggcgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggagggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtgggccctagtttaataaagat

SEQ ID NO: 439232 - DNA, 587 bp, Homo sapiens
  misc_feature (74)..(74): n is a, c, g, or t
  misc_feature (76)..(76): n is a, c, g, or t
agcagcggagtccctacgtcaggccccaccggtatcgtgacatgagacgtgcttcctcaggagactcgactggncnggactacccacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgc

SEQ ID NO: 439233 - DNA, 741 bp, Homo sapiens
  misc_feature (74)..(74): n is a, c, g, or t
  misc_feature (76)..(76): n is a, c, g, or t
  misc_feature (692)..(692): n is a, c, g, or t
agcagcggagtccctacgtcaggccccaccggtatcgtgacatgagacgtgcttcctcaggagactcgactggncnggactacccacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgangcgctggtcgccttgtgggcacggcccccttcggctccgccctgtgccc

SEQ ID NO: 439234 - DNA, 526 bp, Homo sapiens
  misc_feature (74)..(74): n is a, c, g, or t
  misc_feature (76)..(76): n is a, c, g, or t
agcagcggagtccctacgtcaggccccaccggtatcgtgacatgagacgtgcttcctcaggagactcgactggncnggactacccacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattaccttgggattacctgcgctgggtgcagacactgtctgagcaggtgcaggaggagctgctcagctcccaggtcacccaggaactgagggctagtcggggccccgactagcccgacagggctggtggggcctgaggaccagtgaggagtgtggatgtaggcgcccaggcatcgtgcagacagggcgacatcagctggggacgatgggcctgagctagggctggaaagaagggggagccaggcattcatcccggtcacttatgctacagac

SEQ ID NO: 439235 - DNA, 7014 bp, Homo sapiens
  misc_feature (2098)..(2098): n is a, c, g, or t
  misc_feature (2955)..(2955): n is a, c, g, or t
  misc_feature (3993)..(3993): n is a, c, g, or t
  misc_feature (4215)..(4215): n is a, c, g, or t
  misc_feature (4436)..(4436): n is a, c, g, or t
  misc_feature (4679)..(4679): n is a, c, g, or t
  misc_feature (4979)..(4979): n is a, c, g, or t
  misc_feature (5010)..(5010): n is a, c, g, or t
  misc_feature (5295)..(5295): n is a, c, g, or t
  misc_feature (5343)..(5343): n is a, c, g, or t
  misc_feature (5350)..(5350): n is a, c, g, or t
  misc_feature (5696)..(5696): n is a, c, g, or t
  misc_feature (6573)..(6573): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggangtagggagggaggagggtgccactgatcccctgaacccctgcctctgcctcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439236 - DNA, 7318 bp, Homo sapiens
  misc_feature (2098)..(2098): n is a, c, g, or t
  misc_feature (2955)..(2955): n is a, c, g, or t
  misc_feature (3993)..(3993): n is a, c, g, or t
  misc_feature (4215)..(4215): n is a, c, g, or t
  misc_feature (4436)..(4436): n is a, c, g, or t
  misc_feature (4679)..(4679): n is a, c, g, or t
  misc_feature (4979)..(4979): n is a, c, g, or t
  misc_feature (5010)..(5010): n is a, c, g, or t
  misc_feature (5295)..(5295): n is a, c, g, or t
  misc_feature (5343)..(5343): n is a, c, g, or t
  misc_feature (5350)..(5350): n is a, c, g, or t
  misc_feature (5696)..(5696): n is a, c, g, or t
  misc_feature (6573)..(6573): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggangtagggagggaggagggtgccactgatcccctgaacccctgcctctgcctcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaaaaaaaaaaaaaaaaaaaaaaaaaaaaacaaaaaaaaaaaaaaaaaaaaaaaagaaaggggggggcgccgccaaaaaaatttcccccgggggggcccccagctataagcagcaccacgagatgcgtgggacacgcacgcgcccccagagtacaggagcgcgctaataatagccgcaaggacgggggccgatagtattaaacagggtgctgcaggcgggaaaaaccgggcacgcggggagcactggggggagaagaaccccataactgcggggggggagcgccactaagggggacaacctcccgag

SEQ ID NO: 439237 - DNA, 6634 bp, Homo sapiens
  misc_feature (2098)..(2098): n is a, c, g, or t
  misc_feature (2955)..(2955): n is a, c, g, or t
  misc_feature (3993)..(3993): n is a, c, g, or t
  misc_feature (4215)..(4215): n is a, c, g, or t
  misc_feature (4436)..(4436): n is a, c, g, or t
  misc_feature (4679)..(4679): n is a, c, g, or t
  misc_feature (4979)..(4979): n is a, c, g, or t
  misc_feature (5010)..(5010): n is a, c, g, or t
  misc_feature (5295)..(5295): n is a, c, g, or t
  misc_feature (5343)..(5343): n is a, c, g, or t
  misc_feature (5350)..(5350): n is a, c, g, or t
  misc_feature (5696)..(5696): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439238 - DNA, 6838 bp, Homo sapiens
  misc_feature (2098)..(2098): n is a, c, g, or t
  misc_feature (2955)..(2955): n is a, c, g, or t
  misc_feature (3993)..(3993): n is a, c, g, or t
  misc_feature (4215)..(4215): n is a, c, g, or t
  misc_feature (4436)..(4436): n is a, c, g, or t
  misc_feature (4679)..(4679): n is a, c, g, or t
  misc_feature (4979)..(4979): n is a, c, g, or t
  misc_feature (5010)..(5010): n is a, c, g, or t
  misc_feature (5295)..(5295): n is a, c, g, or t
  misc_feature (5343)..(5343): n is a, c, g, or t
  misc_feature (5350)..(5350): n is a, c, g, or t
  misc_feature (5696)..(5696): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagagcctgataaaggtcctgcgggcaggacaggacctcccaaccaagccctccagcaaggattcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgttagaacccttcccagggcacgggagagctggggtgtgtttttgggtggagccctggcagatggtccaagatgaacagattgaaaaaaaaacaagtcctggagaggctgacaacatccctctggtcacacagctagatctcagggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439239 - DNA, 1320 bp, Homo sapiens
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcaaagctgaaatctttatttgtcttttctattatatattggataataaaactctggaggggggtcccattgccaaattggccttatggtgagacttattgcattgcactgcccgtttggttaaactcagcgactgggaaaaccctg

SEQ ID NO: 439240 - DNA, 1206 bp, Homo sapiens
agcgggagccctataattggacaagtctgggagcggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgca

SEQ ID NO: 439241 - DNA, 6762 bp, Homo sapiens
  misc_feature (1846)..(1846): n is a, c, g, or t
  misc_feature (2703)..(2703): n is a, c, g, or t
  misc_feature (3741)..(3741): n is a, c, g, or t
  misc_feature (3963)..(3963): n is a, c, g, or t
  misc_feature (4184)..(4184): n is a, c, g, or t
  misc_feature (4427)..(4427): n is a, c, g, or t
  misc_feature (4727)..(4727): n is a, c, g, or t
  misc_feature (4758)..(4758): n is a, c, g, or t
  misc_feature (5043)..(5043): n is a, c, g, or t
  misc_feature (5091)..(5091): n is a, c, g, or t
  misc_feature (5098)..(5098): n is a, c, g, or t
  misc_feature (5444)..(5444): n is a, c, g, or t
  misc_feature (6321)..(6321): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggangtagggagggaggagggtgccactgatcccctgaacccctgcctctgcctcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439242 - DNA, 6815 bp, Homo sapiens
  misc_feature (1899)..(1899): n is a, c, g, or t
  misc_feature (2756)..(2756): n is a, c, g, or t
  misc_feature (3794)..(3794): n is a, c, g, or t
  misc_feature (4016)..(4016): n is a, c, g, or t
  misc_feature (4237)..(4237): n is a, c, g, or t
  misc_feature (4480)..(4480): n is a, c, g, or t
  misc_feature (4780)..(4780): n is a, c, g, or t
  misc_feature (4811)..(4811): n is a, c, g, or t
  misc_feature (5096)..(5096): n is a, c, g, or t
  misc_feature (5144)..(5144): n is a, c, g, or t
  misc_feature (5151)..(5151): n is a, c, g, or t
  misc_feature (5497)..(5497): n is a, c, g, or t
  misc_feature (6374)..(6374): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggangtagggagggaggagggtgccactgatcccctgaacccctgcctctgcctcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439243 - DNA, 977 bp, Homo sapiens
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgca

SEQ ID NO: 439244 - DNA, 7018 bp, Homo sapiens
  misc_feature (2102)..(2102): n is a, c, g, or t
  misc_feature (2959)..(2959): n is a, c, g, or t
  misc_feature (3997)..(3997): n is a, c, g, or t
  misc_feature (4219)..(4219): n is a, c, g, or t
  misc_feature (4440)..(4440): n is a, c, g, or t
  misc_feature (4683)..(4683): n is a, c, g, or t
  misc_feature (4983)..(4983): n is a, c, g, or t
  misc_feature (5014)..(5014): n is a, c, g, or t
  misc_feature (5299)..(5299): n is a, c, g, or t
  misc_feature (5347)..(5347): n is a, c, g, or t
  misc_feature (5354)..(5354): n is a, c, g, or t
  misc_feature (5700)..(5700): n is a, c, g, or t
  misc_feature (6577)..(6577): n is a, c, g, or t
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtatttcctctaagccccagcctcagtttctctttctgcccacatactggccacacaattctcagccccctcctctccatctgtgtctgtgtgtatctttctctctgccctttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttnattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcncctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaattttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaaccctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctanctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtngcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgtccgcccaccttggcctcccaaagttctgggaatacaggcntgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctnacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataanagcagatagagtgtttgggggaggtagccanccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacagcatgcgccaccacgctcggctaatttttgaattttttgtagagatgaggtctccctatattgcccaggctggtctcgaactcccangctcaagtgatcctccctcttcagcttcccaaagtgctgggattacangcatganccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagntggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggangtagggagggaggagggtgccactgatcccctgaacccctgcctctgcctcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 439245 - DNA, 1163 bp, Homo sapiens
agcgggagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgctgcgggccgccactgtgggctccctggccggccagccgctacaggagcgggcccaggcctggggcgagcggctgcgcgcgcggatggaggagatggtgggcagccggacccgcgaccgcctggacgaggtgaaggagcaggtggcggaggtgcgcgccaagctgggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtgggccctagtttaataaagat

SEQ ID NO: 439246 - DNA, 2229 bp, Homo sapiens
gaaaggcaaggatgtggccttcatgtgatgggcagcatattttctgactcatgcacagatacacttaatactcctcatggaacacaatatcccacgtctccctttacctatccgttcagcagaatggtgctattaaaaaaatggtgctaatatctagatggtggcagaattaatgtaaacatagataggcatacaaatgggtaagtgtatgtgaaactctccatatacatcttctgttaaacatgtaacggtgttgctgaccaatgccagttttattgcttgggtaccttgaatttaagatttaatattatgtgctttttatttttttccaagccattaacgtgtattactctcatgaattcctgtgaaaaataaaacagtgggattgggatgaaattcaagatagaccagaaacaggaggaaagtacaaatgtttacctaaagccagagaatttatttctagatgataattacattattgtattctctgcctttaaacataaacattgctggccgatagcaatctctggtgaataatggttttcgaggagaggagacacttaaattgttagtgacatgagtggaggagaatctgatatttactaatgaggcagtttgcaaagactgtccctgaagtgtagtgtagtctttcagggggattcatttagtaagctagattgatttaacctggtactgtactagcatagggtcaaatacgtgtcatcagagacctgggtatgaccaggcttacaaaactcaggaacaaactcagattcctactgacctcaaccaactaaactaggccaaatttctccgtgtacaaaatggaccacgttatttacaatccacgtggtggagaagatggtagacatgtggagagagtttggccaggtgctccattctaggtctttttccagtttctcaaaggcagaacattggctcctaattatttgccatggatatttgcttcctgttctggagctatgttgtaagacagctgtgtgatgtccatcattcttgactccagaatgaagacagggcttgctgttttctgtcctgttggtatcatctgttgccttggcgatcactcagtgatgagtcgtcagtattttgacatgtcccagtgcttgctgtacaagaggggactcagatcaacaggaagactctgaagacaggaacctgcatggtatcttacatctttgatacttgggtgctgatatgaagcagagttgttgatttactttatctaggcccttctttcttctcacctggatcaagcaactgagaagtgtatcaggagacactggatacatatctctatgaaatagagagggccatcgcagggcctggtacttaactacattaacgttctaaaacccagtttggtttacgttgtctttcacagtagtatatttagctcttctctggaaagttgtgggttaatataattcttaaacatgaaaatgtaattaaacacaccacgagagaacaatattccaggagacttaatagtgattactttcttcaatcaggaaatcgtttcagtgcctcctttgtaggaatgctttgttttgtgatgggttttcttaaagaagagcacacctccgtccaatctcctgagacagccacgtctccgctgacatcccactgtgatgctttcagatagtcagtgaatgtttctgataaccttcatccagtatctgaaacacaatgtgagagattatattgttttagataataacatcccatttagttgactaaaatcttccaaactctgaaagctgcacactgctactccagagagtgcaggtcttagctcttctcctttctgacttcaagatgaatctttgggacgatgtttctggtgcttggtccacagtgattcacttttgaaggagaggccacatgacatgaactgcctggtgttacaacctagctaacatatttgatgctactcctgttgtctgtactgcttattcaagtagtattctaagttatgttactaaaaaacatggtgggtaaagcacaatcctacccatcattgtcctccaaaataattgtatgacatacacggcccagcccattgccctccctgcatctctgtgctgctttgccatttccccttctacccagcctcctcaaggggtaccttggtggatatttcagtacttaaaaccagactgtaatcataacctccctctgtgtggcatcaataaatagccaaactca

SEQ ID NO: 439247 - DNA, 274 bp, Homo sapiens
gcggccgcctactactactactgctcgaattcaagcttctaacgatgtacggggacatggtgggtaaagcacaatcctacccatcattgtcctccaaaataattgtatgacatacacggcccagcccattgccctccctgcatctctgtgctgctttgccatttccccttctacccagcctcctcaaggggtaccttggtggatatttcagtacttaaaaccagactgtaatcataacctccctctgtgtggcatcaataaatagccaaactca

SEQ ID NO: 439248 - DNA, 362 bp, Homo sapiens
tgccacctgtcctcacctcttctcaggttggaaaatggaggttccatattaaaatatttcaaagaaccaggtaaattgtactaagtacaagaacatagtgcaaacttctaatctagagaaaaaacatttctaaaaagtaaggtaaaggggatctactcctcagtgtacccatcattgtcctccaaaataattgtatgacatacacggcccagcccattgccctccctgcatctctgtgctgctttgccatttccccttctacccagcctcctcaaggggtaccttggtggatatttcagtacttaaaaccagactgtaatcataacctccctctgtgtggcatcaataaatagccaaactca

SEQ ID NO: 439249 - DNA, 428 bp, Homo sapiens
ctgtgggttccttttacaatgtgaacctcaagtactaaaagtgcatttttaaagaaatattctgcatttcaggtttcccactaattatgactggccttctcccaagttagtttgagctattttggtgaggttttatagtgatttaataagaaaagcttttttaaaacctcataaaaccttctgtacaattcattctgaccaacattccctcttacaattatgtcattaacaacttctttttaaaagaccagaacttttgtctattcatgttaaccttaaaagcagcattcaccgaacccctgagaaacaaggagagctataatactttacaggattggggcagagcacatgaaatcatgtgtgagagagggttctgtacatttgtttttcttaattgccatttctgacttgggcagcctccccaccca

SEQ ID NO: 439250 - DNA, 384 bp, Homo sapiens
tggtaacttataaagaacagaaatttatttcttattgttctcaaggctgggaagtctaagatcaaatcaccagcaggttggggtctggtgagggtctagtccctgcctccaagatgatgtctcattgctgtatgctccggaaaggaggaacagtgtccccacaaagtggaaggacaataggtccaactccttccttcaggcccttttataaaaacacctaatcccattcatgagggtggagccctcatggcctaattacatcttcaaggccccacctcttaataccatcacattggcagcacctgaattttggaggggacacagtcataccatagcaatgcctaaaactgatttcttggtcttattccccaagcctgaccctaa

SEQ ID NO: 439251 - DNA, 1228 bp, Homo sapiens
gctgaaaccctgtacttctgttcgcggccgtgtagagctgccccttatgccacagcttcctcatccatacgtaggggtgatgttggcaaggcctccggggcgctcaggatcaaaggcggcggcagtgtcctgccaagtgttcacagctgatgagacgtggtccctgaacacagcggttcctgttctgatcactcgagtctccgtgatgccaccgttcccagaaggcagcccgtgcagcctccgggtccccccttcagccatggcagcccgtgcagcctccgggtcgtcccttcggccaagcttccctttccttgagagcagcacgctggcctggccatgcagaacaaaacacaactcagaaatccctcctcagccctcggcagtaaaacttctgaggattcgactttttagttaatttgctcactgtggcagctcactggaaaataaatcgaggatgccaagtcctcctcttagaaaaatagcccctgcagtggggtttgctgatgtgctcatttgtgtcattgcaggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcatttttcttgacctggtataatgaaagtatttcagatatttgagtttaacccttttccagaaagtaatacatgatatggatttatttatgcattaaaagagcaaatttaaagagc

SEQ ID NO: 439252 - DNA, 481 bp, Homo sapiens
ccttagtcacagctcagctgtgctcagatcctccctgagtctattaatatcactgtgttgaatttcacaacagtttggcacttacagcgaatctgagaggaaaaccgaggagtacgatactcaggtaagtcacttgtgattcagggcacgtgcatgccaggcaaatccaacaccctcaaagacgggtcttttactgtcattgctcagtgcggaagtctccttggagtacgggtcagcccgccttgagcagggatcccaagagtgaacacataaaacccaaatttcttactgggaagggcgggggctcgcagagactcatttcccagtccttacaggcacagcctgcctgtgtcaccgtatagtagggatattttcatcgtttgtaagtcacattcgccaggcagctgacgcaggccatggtgtctgctgtggttgctgggaacgcacttgccgtcaccaaggccataatggccgcggccgc

SEQ ID NO: 439253 - DNA, 300 bp, Homo sapiens
  misc_feature (232)..(232): n is a, c, g, or t
tggaatgtgcctgtagaggaggagctggatggaatgtgcctgtagaggaggagctggatggaatgtgtctgtagaggaggagctggatggaatgtgtctgtagaggaggagctggatgaaatgtccctgtagaggaggagctggatggaatgcgtacaggtaaccaaggtaacaggtgtgagttattgattagagttgacgtgaagcaggtaggctgtttacagtaactagngtcaaggaagaacaagaaagtcgagttcgagaacaaaggataaggaagttaaccagctaaataaaccc

SEQ ID NO: 439254 - DNA, 2442 bp, Homo sapiens
atggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439255 - DNA, 2498 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcatttttcttgacctggtataatgaaagtatttcagatatttgagtttaacccttttccagaaagtaatacatgatatggatttatttatgcattaaaagagcaaatttaaagagc

SEQ ID NO: 439256 - DNA, 2520 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcatttttcttgacctggtataatgaaagtatttcagatatttgagtttaacccttttccagaaagtaatacatgatatggatttatttatgcattaaaagagcaaatttaaagagccaaaaaaacaaaaaaagggcgc

SEQ ID NO: 439257 - DNA, 2407 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcaaaacagatacaaaccatatcgac

SEQ ID NO: 439258 - DNA, 1688 bp, Homo sapiens
agtgatgttggatgtaaagtgaaatattagttggcggatgaagcagatagtgaggaaagttgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439259 - DNA, 2432 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcaggtggggtctgccctgcaccccctcccagcccgaccatcctgtccccagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439260 - DNA, 2280 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439261 - DNA, 2006 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgcgcagcagtgccatggattgtcagagttttggagcttggggaatcctaaaatggttttggttgcaattcttggactttcaaattcccatcccctaatggtgagaaaccc

SEQ ID NO: 439262 - DNA, 1198 bp, Homo sapiens
  misc_feature (60)..(60): n is a, c, g, or t
  misc_feature (136)..(136): n is a, c, g, or t
accaaggcagtgctctggcgctgcttcagcaccgtggtcatctttctgttcctgctggancgaaaggccaatgaaacccggaaagggccccctttggcctttgtgggttggccttgggggttcccccggtgccggngggtgtttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439263 - DNA, 1032 bp, Homo sapiens
ccagtggctgacaccaggtcattctgaccctcagctaggagtggccgctgttgccgcatgagtggcagagaccatcgggcttcagcctcacctccctggccctctgccttgccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439264 - DNA, 1130 bp, Homo sapiens
ccttagtcacagctcagctgtgctcagatcctccctgagtctattaatatcactgtgttgaatttcacaacagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaaggtaaggcggtgtgtgctgcccgcggcccggcccccgtctcctgtgctgcccacagctgacctgggcctgtctctcctgtttcagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439265 - DNA, 1701 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtatcctctctgcgtttgcaaacgcagagaggacaaacgcagagggaacgcagagaggacaaacgcagagaggttctcgcgttgaccaaggaacgtcatactcctgcttgctgatcctctcttgcgttcaaacgcagagaggacttgaataggagttcttctcgcgttgaccaaggacgtcatactcctgcttgctgatcctctctgcgtttg

SEQ ID NO: 439266 - DNA, 1114 bp, Homo sapiens
gctgaaaccctgtacttctgttcgcggccgtgtagagctgccccttatgccacagcttcctcatccatacgtaggggtgatgttggcaaggcctccggggcgctcaggatcaaaggcggcggcagtgtcctgccaagtgttcacagctgatgagacgtggtccctgaacacagcggttcctgttctgatcactcgagtctccgtgatgccaccgttcccagaaggcagcccgtgcagcctccgggtccccccttcagccatggcagcccgtgcagcctccgggtcgtcccttcggccaagcttccctttccttgagagcagcacgctggcctggccatgcagaacaaaacacaactcagaaatccctcctcagccctcggcagtaaaacttctgaggattcgactttttagttaatttgctcactgtggcagctcactggaaaataaatcgaggatgccaagtcctcctcttagaaaaatagcccctgcagtggggtttgctgatgtgctcatttgtgtcattgcaggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439267 - DNA, 907 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcgggatcctctagacgacctc

SEQ ID NO: 439268 - DNA, 2384 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439269 - DNA, 2522 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcatttttcttgacctggtataatgaaagtatttcagatatttgagtttaacccttttccagaaagtaatacatgatatggatttatttatgcattaaaagagcaaatttaaagagcaaaaaaaaaaataaaaaaataaaa

SEQ ID NO: 439270 - DNA, 2276 bp, Homo sapiens
atggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439271 - DNA, 2468 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaaggtaaggcggtgtgtgctgcccgcggcccggcccccgtctcctgtgctgcccacagctgacctgggcctgtctctcctgtttcagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439272 - DNA, 2326 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggaaatggacctaaatggacaatggacctaaatgga

SEQ ID NO: 439273 - DNA, 2113 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439274 - DNA, 1545 bp, Homo sapiens
atatgtccctgtagaggaggagctggatgaaatgtccccgtagaggaggagctggatggaatgtccccgtagaggaggagctggatggaatgtccctgtagaggaggagctggatgaaatgtgtctgtagaggaggagctggatgaaatgtgtctgtagaggaggagctggatgaaatgtgtctgtagaggaggagctggatggaatgtgtctagaggaggagctggatgaaatgtgtcggtagaggaggagctggatggaatgtccctgtagaggaggagctggatgaaatgtgtctgtggaggaggagctggatgaaatgaaatgtgtctgtcgaggaggagctggatgaaatgtgtctgtagaggaggagctggatgaaatgtgtctgtagaggaggagctgcatggaatgtgtctgtagaggaggagctggatggaatgtccctgtagaggaggagctggatgaaatgacgctggagctccacaggcagggtccctccatagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439275 - DNA, 1698 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgtctaggaattcctccagatgccttccaaaaatactcatcgacgagttcagttgcacccggctggcggcagtcccggccggccgttcagtccagatgtggggcgcccgcg

SEQ ID NO: 439276 - DNA, 1605 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggca

SEQ ID NO: 439277 - DNA, 1819 bp, Homo sapiens
cgcgtccacttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggtaagtcacttgtgattcagggcacgtgcatgccaggcaaatccaacaccctcaaagacgggtcttttactgtcattgctcagtgcggaagtctccttggagtacgggtcagcccgccttgagcagggatcccaagagtgaacacataaaacccaaatttcttactgggaagggcgggggctcgcagagactcatttcccagtccttacaggcacagcctgcctgtgtcaccgtatagtagggatattttcatcgtttgtaagtcacattcgccaggcagctgacgcaggccatggtgtctgctgtggttgctgggaacgcacttgccgtcaccaaggccataatggccgcggccgc

SEQ ID NO: 439278 - DNA, 1371 bp, Homo sapiens
  misc_feature (1071)..(1071): n is a, c, g, or t
  misc_feature (1145)..(1145): n is a, c, g, or t
atggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacaggcttcccccccgctcaacggggggtcctatggccctnttggctttcctcttcatgctgccccagctctttgtgaactacaagttgaagtcagtggcacattcttggccccnccttgggggcaaaaaagggggggcccccccttttttttccaaaacgctttaaccaaaaggggcgttttttcaaacaagctttcaacaccttcattgatgacgtctttgccttcatcatcaccatgcccacgtctcaccggctggcctgcttccgggacgacgtgggttgtttttcccttggggttcctaaacctgggggtaacccaaggggggggtttatcctgtg

SEQ ID NO: 439279 - DNA, 378 bp, Homo sapiens
cggccgccgccgtttgatggatccgaggatcgcctggtttcagccagagcagctcggaccgtccaacagtctgtggatgcagatctgggagacgacccaggggctgaggaacctctacttcaaccaccactgtcacagcagcggcggcgcgagcggcggcggcggcagcagcagcagcagcagcacggccaccggcgggagcggcagcagcaccggcagccccggcggcgcggcctcggccccggccccggccccggccggcatgtatcgctccggggagcgcctgctgggcagccacgcgctgcccgcggagcagcgggacttcctgcccctagagacgaccaacaacaacaacaaccaccaccagcccggggcctg

SEQ ID NO: 439280 - DNA, 3651 bp, Homo sapiens
gacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatgtcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgccatatatttaccattttattgtgtgtatatatagaagaccatataggaaattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaaga

SEQ ID NO: 439281 - DNA, 3594 bp, Homo sapiens
gacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatgtcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgccatatatttaccattttattgtgtgtatatatagaagaccatataggaaattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacattttctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaaga

SEQ ID NO: 439282 - DNA, 3830 bp, Homo sapiens
gacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatggaaatggtgttaccttgatagtagatactcagcagttagataaatgtaataataatctatctgaagaaaatgaagcccttggaaaatgtagaagtaaaacctcggaatctcttagtaaacactcttcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgccatatatttaccattttattgtgtgtatatatagaagaccatataggaaattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaaga

SEQ ID NO: 439283 - DNA, 3584 bp, Homo sapiens
gacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatgtcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgccatatatttaccattttattgtgtgtatatatagaagaccatataggaaattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagtagacaggcggcaccggccggaacgaagaaatcacctacatggagaaggataaagtaacctaggggacgaacgacgatgtcccaacaggctgctccagacatacagggggtggcacaggcaccacaagggtccaaggaaacaccgcccgcaacctcggcacacgaaccgacagtagaaatcgacgaggagaagaccagagaaaacaacgacgaacaggggagaaacacgagcaaacacgagtactcacaagc

SEQ ID NO: 439284 - DNA, 2422 bp, Homo sapiens
  misc_feature (2203)..(2203): n is a, c, g, or t
  misc_feature (2216)..(2216): n is a, c, g, or t
  misc_feature (2230)..(2230): n is a, c, g, or t
  misc_feature (2245)..(2245): n is a, c, g, or t
  misc_feature (2381)..(2381): n is a, c, g, or t
gacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatgtcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgccatatatttaccattttattgtgtgtatatatagaagaccatataggaaattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaggggccccccttgnggggcccattccngggggcgggaaacnttggggtcccaaaantttggctggcgggtttttaaacccgggggggcgggggggcccggttccaaacccttattttttttaaaaatccagcctaacctccgggggggaaaaacctgaaaccggctttatttaattcttccttataaaaacntttttttttatttccccctctagcctctgggtttggggaac

SEQ ID NO: 439285 - DNA, 2513 bp, Homo sapiens
cggccgccgccgtttgatggatccgaggatcgcctggtttcagccagagcagctcggaccgtccaacagtctgtggatgcagatctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgccatatatttaccattttattgtgtgtatatatagaagaccatataggaaattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaaga

SEQ ID NO: 439286 - DNA, 1600 bp, Homo sapiens
tggtcaccacctcctggctcggggaaccgctctggccctttggacagccatggccccgatttccgaatcggggcccggacccccaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaaga

SEQ ID NO: 439287 - DNA, 1554 bp, Homo sapiens
  misc_feature (23)..(23): n is a, c, g, or t
ctatatcgcactggggccgcccncagagagagcgctctgtgtgtgtgtgtgtgtgtgtgtgtgtgtgtgtgtcggcctcagagcgcgctgtgtgtgtgtgtgtgtgtgtcagcctcagagcgcgcctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaaga

SEQ ID NO: 439288 - DNA, 3705 bp, Homo sapiens
gacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatgtcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgccatatatttaccattttattgtgtgtatatatagaagaccatataggaaattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaaga

SEQ ID NO: 439289 - DNA, 3597 bp, Homo sapiens
gacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatgtcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgccatatatttaccattttattgtgtgtatatatagaagaccatataggaaattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaatttcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaaga

SEQ ID NO: 439290 - DNA, 4239 bp, Homo sapiens
gacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatgtcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgccatatatttaccattttattgtgtgtatatatagaagaccatataggaaattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaagaacttttagtttgcctgctcatttgttttatacatttcatctatttgactcctatcttatttcttttttgagttttaatacttcctatattttgtgaatatatcagaaatgtgtcatttatatattagagtccattcatatccatgaatcataaccttcctttgctaatacttgttgaatgggattttacaaattctccctcactctggtgacatttctcaggcagtcatgtatgtgtacctggccattagaaatattaatatttaaagactgttttttagaggagctgatgggttggtgaggtgtcagcacaaaatcttactggttatgttttgatgataaaagtatatccattttttccctccagctttaaggtgactgtgaaggtgcctggttttgaatgtctttgtttggtttggagatgtcgcactcagttttcaaatctagcttggatctgtaggacctatgttttttacaagtaattgccctccagtcttcaacagttgattctgttttatttttatcctgttttgag

SEQ ID NO: 439291 - DNA, 3651 bp, Homo sapiens
gacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatgtcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgccatatatttaccattttattgtgtgtatatatagaagaccatataggaaattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaaga

SEQ ID NO: 439292 - DNA, 1362 bp, Homo sapiens
  misc_feature (1299)..(1299): n is a, c, g, or t
gacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatggaaatggtgttaccttgatagtagatactcagcagttagataaatgtaataataatctatctgaagaaaatgaagcccttggaaaatgtagaagtaaaacctcggaatctcttagtaaacactcttcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcacagagaagacagtccancgcgcagcgctgactatctacagaggtctgagaggggcgcgtccctcttgtgtttcctctttt

SEQ ID NO: 439293 - DNA, 929 bp, Homo sapiens
  misc_feature (879)..(879): n is a, c, g, or t
tcaggtggagatcgcagggctgaacacagacctgcagcaggagtacacccggcagcgggagcacctggagaggaacctggccactctcaagaagaaggtggtcaaggagggcgagctgcaccgcacagactacgtccgcatcatgcaggaaaatgtctctctgatcaaggaaattaatgagctccgcagggagctgaagttcactcggtcccaagtctatgaccttgaagcagctctgaaactgaccaagaaagtccgaccacaagaagtttcagagacagaacccagcagggacatgctcagcacagctcccaccgcaaggttgaatgagcaagaagaaactgggaggatcattgaaatgcagcgcctagaaatccagcgcctcagagaccagatccaagagcaagagcaggtcacagggttccacaccctcgctggagttcggcttccttccctctccaactccgaggtagacttagaggtgaagaccaactgaccccctctggtgagccatctccagccacagccagaagaaacacagcatgtctgtccccaagccagacttgcggttggagtctgtatggtccctgcagcactgaccccagcaacctctttctcttgccctggggaatttgggacacagaataaaggatgatcccggcgttccctttaatgagggttattcttgaacctcctcaactgctcttgcgctcggtcgatccctcagcaagtcgataatctactcatagcggaatacgttttcacgaatgagggatacccatgaaaactggggccaaggcataaatgccagaacctaaaagccggttttgggatttcctagctccccccctacaagatcaaaaataagccttagttgtncggggaacccgccggcttaaaatccccacaaaccctgaaccccttccact

SEQ ID NO: 439294 - DNA, 785 bp, Homo sapiens
gggaggccgggtctcccaggttaacaatgggaagtccaagagtttgttaggagctccccccacggcttatctcggtaagtagaggattagatcgtagtaaatcaaagacttatttcagtagtcaagttacctgacatgataattatttctgcaggataattgatgttttatgttcttttttggactttatcttcttgcaaaaatttctacaaaaattgttttcttcatccttgtggtgcttattcatctgagccgtctccacagtcccaatgcctctgctttttgttttacttttgtagcataaggtttttgcttttgctttgccttaagagttccctagggagttaccagggcttttcgttttgtgtagcttttgcagcatggatcaaacattggcttactgtgctaatgtgtgaagagaaaaaattctctaaagcaggtgagctttaatgaacaaatgtttttgggttttttttttttttttgtaattatatgaagaaagtccagttctcataaatattgatcacttaaaaaacttactctttcttgaaaaggtacacatgtaaaatttaggaaaataactaaagtaggggctggaaccataagaagaatgtttatcagcacgttcatttattattttggatttggaacttggctttgtttttcaatagtgacaagaatggttcagttctaggaatgttctggaagatgctgttaattttactttaaaatgagaatctggtgttactgtattttatcgttttcaataaaacttcttaagtgtt

SEQ ID NO: 439295 - DNA, 3939 bp, Homo sapiens
ttctagaaggcgtgacgtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaagttatacttgtattagcaagtttttttttttttcccccaccgcaacctccatctcccgggttcaagcaattctcctgcctcaccctcccaagtagctgggattacaggtgcccacctccacgcccagctaatttttgtatttttaatagagaccggttttgccatgttggccaggctggtctcgaactcctgacctcaggtgatctgcccaccccagcctcccaaaatgctgggattacaggcgtgagccacggcacgcagccagcaagttgtttttaaatgttaatatagaaaacagtgaaggattagctgaaaatatatgagcaggtgacattgaggtttactgaaatagccaatttgactggtgcttagactattgtgcagtaaacctaaaaggtagtggagaattgcttcctgctagcaggaagccttcatcttcttgagtacccaaaccaggcttcaggtgtcctttgaggatagccaggtttgaaatttttagtttctcaggaagagctcttctatgtggcaggggctgatagggcaaaataaaatgacaatttctttattgctacagagtatcctctataagttattaaacgagtgtaatggtataatgcccttccatcacacaacaggacaccaccccagttttgttttctgggtttcttccccctttgtaggaatcagataccttttgtagaaaaaaatggcttatgccacgtaaaggtgaatttttagaaaccaccttctaggcgtttttggaacccttactgaaatccctccccttgttacagatggcgtagaagtcacaagtctgttaattggactgttgcttctttgcctgttcctgctttctctttctgtctggatagtcaggaaaagatttaatgtttaatatttaaacaaaatatttaatgtctatacagtaaaattattcaaacttcaaaccagtattgaaagcagttggaaaccagctaatagtttcttaatctcagatttcgagatgaatgtaaactgtattcttttgaaatgtgcaagtgtttgattcatgccatttgataaacttctgccttgtagtcattgtttgatgggaccaacttgtaaagtatgagccttaaataaatctccatgctgaaaaatgtgttctaatgcaacacaaaaacatgaagtgactgcccagaggtagagttagtgtttaggtggaaagggagatgacagctttccaaagaaggacctaaaacacaccaagattgtcttctacaggaattgctgggcaggtctccgactaaaggtcttatgatgaaaaggaagaaacaagcccccaacacaaggctctgatactactggtaaatgtaggagagaattaagaatctgttaattaaaatccaaacagagcttatttcagtagtcaagttacctgacatgataattatttctgcaggataattgatgttttatgttcttttttggactttatcttcttgcaaaaatttctacaaaaattgttttcttcatccttgtggtgcttattcatctgagccgtctccacagtcccaatgcctctgctttttgttttacttttgtagcataaggtttttgcttttgctttgccttaagagttccctagggagttaccagggcttttcgttttgtgtagcttttgcagcatggatcaaacattggcttactgtgctaatgtgtgaagagaaaaaattctctaaagcaggtgagctttaatgaacaaatgtgtattttatctgagtttgagtagggtgcgttgtggattttgttttttgggttttttttttttttttgtaattatatgaagaaagtccagttctcataaatattgatcacttaaaaaacttactctttcttgaaaaggtacacatgtaaaatttaggaaaataactaaagtaggggctggaaccataagaagaatgtttatcagcacgttcatttattattttggatttggaacttggctttgtttttcaatagtgacaagaatggttcagttctaggaatgttctggaagatgctgttaattttactttaaaatgagaatctggtgttactgtattttatcgttttcaataaaacttcttaagtgtt

SEQ ID NO: 439296 - DNA, 4312 bp, Homo sapiens
ttctagaaggcgtgacgtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaagttatacttgtattagcaagtttttttttttttcccccaccgcaacctccatctcccgggttcaagcaattctcctgcctcaccctcccaagtagctgggattacaggtgcccacctccacgcccagctaatttttgtatttttaatagagaccggttttgccatgttggccaggctggtctcgaactcctgacctcaggtgatctgcccaccccagcctcccaaaatgctgggattacaggcgtgagccacggcacgcagccagcaagttgtttttaaatgttaatatagaaaacagtgaaggattagctgaaaatatatgagcaggtgacattgaggtttactgaaatagccaatttgactggtgcttagactattgtgcagtaaacctaaaaggtagtggagaattgcttcctgctagcaggaagccttcatcttcttgagtacccaaaccaggcttcaggtgtcctttgaggatagccaggtttgaaatttttagtttctcaggaagagctcttctatgtggcaggggctgatagggcaaaataaaatgacaatttctttattgctacagagtatcctctataagttattaaacgagtgtaatggtataatgcccttccatcacacaacaggacaccaccccagttttgttttctgggtttcttccccctttgtaggaatcagataccttttgtagaaaaaaatggcttatgccacgtaaaggtgaatttttagaaaccaccttctaggcgtttttggaacccttactgaaatccctccccttgttacagatggcgtagaagtcacaagtctgttaattggactgttgcttctttgcctgttcctgctttctctttctgtctggatagtcaggaaaagatttaatgtttaatatttaaacaaaatatttaatgtctatacagtaaaattattcaaacttcaaaccagtattgaaagcagttggaaaccagctaatagtttcttaatctcagatttcgagatgaatgtaaactgtattcttttgaaatgtgcaagtgtttgattcatgccatttgataaacttctgccttgtagtcattgtttgatgggaccaacttgtaaagtatgagccttaaataaatctccatgctgaaaaatgtgttctaatgcaacacaaaaacatgaagtgactgcccagaggtagagttagtgtttaggtggaaagggagatgacagctttccaaagaaggacctaaaacacaccaagattgtcttctacaggaattgctgggcaggtctccgactaaaggtcttatgatgaaaaggaagaaacaagcccccaacacaaggctctgatactactggtaaatgtaggagagaattaagaatctgttaattaaaatccaaacagagcttatttcagtagtcaagttacctgacatgataattatttctgcaggataattgatgttttatgttcttttttggactttatcttcttgcaaaaatttctacaaaaattgttttcttcatccttgtggtgcttattcatctgagccgtctccacagtcccaatgcctctgctttttgttttacttttgtagcataaggtttttgcttttgctttgccttaagagttccctagggagttaccagggcttttcgttttgtgtagcttttgcagcatggatcaaacattggcttactgtgctaatgtgtgaagagaaaaaattctctaaagcaggtgagctttaatgaacaaatgtgtattttatctgagtttgagtagggtgcgttgtggattttgttttttgggttttttttttttttttgtaattatatgaagaaagtccagttctcataaatattgatcacttaaaaaacttactctttcttgaaaaggtacacatgtaaaatttaggaaaataactaaagtaggggctggaaccataagaagaatgtttatcagcacgttcatttattattttggatttggaacttggctttgtttttcaatagtgacaagaatggttcagttctaggaatgttctggaagatgctgttaattttactttaaaatgagaatctggtgttactgtattttatcgttttcaataaaacttcttaagtgttttggacttttgagatatttgtattactccacttaaataatgaaatcagatatctcctttcctctgaattgtagttgaagcagcattcatatcagtgaaggacttaaatttatcctgaagggatgattatgttgggataaagctaagtatcatatttgaattagctgttcccacaataggcaggccatgtgttgctattctaaaacccatagactgctttccactcagagcagttcactgctattgttagtatttagatggcagtggtaactgtgtattcaaaaatgttaaaatgggctaggtacgatggtgcacacctgtgccagcactttgtgagactgaggcaggaggatcacttaagctgaggagagacc

SEQ ID NO: 439297 - DNA, 2708 bp, Homo sapiens
  misc_feature (2526)..(2526): n is a, c, g, or t
  misc_feature (2537)..(2537): n is a, c, g, or t
  misc_feature (2539)..(2539): n is a, c, g, or t
  misc_feature (2541)..(2541): n is a, c, g, or t
  misc_feature (2543)..(2543): n is a, c, g, or t
ttctagaaggcgtgacgtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaagttatacttgtattagcaagtttttttttttttcccccaccgcaacctccatctcccgggttcaagcaattctcctgcctcaccctcccaagtagctgggattacaggtgcccacctccacgcccagctaatttttgtatttttaatagagaccggttttgccatgttggccaggctggtctcgaactcctgacctcaggtgatctgcccaccccagcctcccaaaatgctgggattacaggcgtgagccacggcacgcagccagcaagttgtttttaaatgttaatatagaaaacagtgaaggattagctgaaaatatatgagcaggtgacattgaggtttactgaaatagccaatttgactggtgcttagactattgtgcagtaaacctaaaaggtagtggagaattgcttcctgctagcaggaagccttcatcttcttgagtacccaaaccaggcttcaggtgtcctttgaggatagccaggtttgaaatttttagtttctcaggaagagctcttctatgtggcaggggctgatagggcaaaataaaatgacaatttctttattgctacagagtatcctctataagttattaaacgagtgtaatggtataatgcccttccatcacacaacaggacaccaccccagttttgttttctgggtttcttccccctttgtaggaatcagataccttttgaaaanctactgaatcntncntngtcagatgcgaaagtacaagctgtaatgactgtgctcttgctgtctgcttcttttgctgatgcggaaagattatgtatataacaatattatgcatcagaaatatcaactcaacagatgagcatggacagtatgtctattcgatcgagattactgtcttaagtgaa

SEQ ID NO: 439298 - DNA, 1576 bp, Homo sapiens
ttctagaaggcgtgacgtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaagaacaaaaaagaaaaaacataataaagaaaacatagaaagaaatagagcgcgcggcgccggcggcccaccagcacgcattcaacagcgcggccacacaacacctccactcacaccgcgcccccgcccggacaaccgaaccacgc

SEQ ID NO: 439299 - DNA, 3885 bp, Homo sapiens
ttctagaaggcgtgacgtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaagttatacttgtattagcaagtttttttttttttcccccaccgcaacctccatctcccgggttcaagcaattctcctgcctcaccctcccaagtagctgggattacaggtgcccacctccacgcccagctaatttttgtatttttaatagagaccggttttgccatgttggccaggctggtctcgaactcctgacctcaggtgatctgcccaccccagcctcccaaaatgctgggattacaggcgtgagccacggcacgcagccagcaagttgtttttaaatgttaatatagaaaacagtgaaggattagctgaaaatatatgagcaggtgacattgaggtttactgaaatagccaatttgactggtgcttagactattgtgcagtaaacctaaaaggtagtggagaattgcttcctgctagcaggaagccttcatcttcttgagtacccaaaccaggcttcaggtgtcctttgaggatagccaggtttgaaatttttagtttctcaggaagagctcttctatgtggcaggggctgatagggcaaaattgtaatggtataatgcccttccatcacacaacaggacaccaccccagttttgttttctgggtttcttccccctttgtaggaatcagataccttttgtagaaaaaaatggcttatgccacgtaaaggtgaatttttagaaaccaccttctaggcgtttttggaacccttactgaaatccctccccttgttacagatggcgtagaagtcacaagtctgttaattggactgttgcttctttgcctgttcctgctttctctttctgtctggatagtcaggaaaagatttaatgtttaatatttaaacaaaatatttaatgtctatacagtaaaattattcaaacttcaaaccagtattgaaagcagttggaaaccagctaatagtttcttaatctcagatttcgagatgaatgtaaactgtattcttttgaaatgtgcaagtgtttgattcatgccatttgataaacttctgccttgtagtcattgtttgatgggaccaacttgtaaagtatgagccttaaataaatctccatgctgaaaaatgtgttctaatgcaacacaaaaacatgaagtgactgcccagaggtagagttagtgtttaggtggaaagggagatgacagctttccaaagaaggacctaaaacacaccaagattgtcttctacaggaattgctgggcaggtctccgactaaaggtcttatgatgaaaaggaagaaacaagcccccaacacaaggctctgatactactggtaaatgtaggagagaattaagaatctgttaattaaaatccaaacagagcttatttcagtagtcaagttacctgacatgataattatttctgcaggataattgatgttttatgttcttttttggactttatcttcttgcaaaaatttctacaaaaattgttttcttcatccttgtggtgcttattcatctgagccgtctccacagtcccaatgcctctgctttttgttttacttttgtagcataaggtttttgcttttgctttgccttaagagttccctagggagttaccagggcttttcgttttgtgtagcttttgcagcatggatcaaacattggcttactgtgctaatgtgtgaagagaaaaaattctctaaagcaggtgagctttaatgaacaaatgtgtattttatctgagtttgagtagggtgcgttgtggattttgttttttgggttttttttttttttttgtaattatatgaagaaagtccagttctcataaatattgatcacttaaaaaacttactctttcttgaaaaggtacacatgtaaaatttaggaaaataactaaagtaggggctggaaccataagaagaatgtttatcagcacgttcatttattattttggatttggaacttggctttgtttttcaatagtgacaagaatggttcagttctaggaatgttctggaagatgctgttaattttactttaaaatgagaatctggtgttactgtattttatcgttttcaataaaacttcttaagtgtt

SEQ ID NO: 439300 - DNA, 3484 bp, Homo sapiens
ttctagaaggcgtgacgtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaagttatacttgtattagcaagtttttttttttttcccccaccgcaacctccatctcccgggttcaagcaattctcctgcctcaccctcccaagtagctgggattacaggtgcccacctccacgcccagctaatttttgtatttttaatagagaccggttttgccatgttggccaggctggtctcgaactcctgacctcaggtgatctgcccaccccagcctcccaaaatgctgggattacaggcgtgagccacggcacgcagccagcaagttgtttttaaatgttaatatagaaaacagtgaaggattagctgaaaatatatgagcaggtgacattgaggtttactgaaatagccaatttgactggtgcttagactattgtgcagtaaacctaaaaggtagtggagaattgcttcctgctagcaggaagccttcatcttcttgagtacccaaaccaggcttcaggtgtcctttgaggatagccaggtttgaaatttttagtttctcaggaagagctcttctatgtggcaggggctgatagggcaaaataaaatgacaatttctttattgctacagagtatcctctataagttattaaacgagtgtaatggtataatgcccttccatcacacaacaggacaccaccccagttttgttttctgggtttcttccccctttgtaggaatcagataccttttgtagaaaaaaatggcttatgccacgtaaaggtgaatttttagaaaccaccttctaggcgtttttggaacccttactgaaatccctccccttgttacagatggcgtagaagtcacaagtctgttaattggactgttgcttctttgcctgttcctgctttctctttctgtctggatagtcaggaaaagatttaatgtttaatatttaaacaaaatatttaatgtctatacagtaaaattattcaaacttcaaaccagtattgaaagcagttggaaaccagctaatagtttcttaatctcagatttcgagatgaatgtaaactgtattcttttgaaatgtgcaagtgtttgattcatgccatttgataaacttctgccttgtagtcattgtttgatgggaccaacttgtaaagtatgagccttaaataaatctccatgctgaaaaatgtgttctaatgcaacacaaaaacatgaagtgactgcccagaggtagagttagtgtttaggtggaaagggagatgacagctttccaaagaaggacctaaaacacaccaagattgtcttctacaggaattgctgggcaggtctccgactaaaggtcttatgatgaaaaggaagaaacaagcccccaacacaaggctctgatactactggtaaatgtaggagagaattaagaatctgttaattaaaatccaaacagagcttatttcagtagtcaagttacctgacatgataattatttctgcaggataattgatgttttatgttcttttttggactttatcttcttgcaaaaatttctacaaaaattgttttcttccagaacattcctagaactgaaccattcttgtcactattgaaaaacaaagccaagttccaaatccaaaataataaatgaacgtgctgataaacattcttcttatggttccagcccctactttagttattttcctaaattttacgtcga

SEQ ID NO: 439301 - DNA, 881 bp, Homo sapiens
  misc_feature (664)..(664): n is a, c, g, or t
taaactgtagagatagcatggcaagacatgtacagatgcaaccttttacatttatatactcttttacatttatataaatgtaaaagagtgtataaactgtagagatagcattggcaagacattgtacagatgcaaccttttacacaacatcattgtgtaatttgtaaagattcacgtgtagttctttattatagtgattttgggctttgtacccactgaatgccattttttgtgtttttaaattattttctttatcttgttacaaaaactgagatgtggggttttttttttttcagttcacttatcattagaatgtctgaacttttatgtaacatttttgtgtgcatctctcaatgctaacaccacatgtttgcctatgacaagtttatagagtgaaaggtatcttctgggttgaaataattcacaaattggtgaatgtcatcttgcaacacaccctgtacagtcttccttaaaggaacactacagtatatttttagtatctacatgctgaatgactgaatacagacctaagcacagcagtggtcctggtacagtatttaagtgtcggcatacacaggcgtaatccctgtataaagtagtgccaaactgatttcagttgtgtaactagtttaaaacccaataaatggattctttttaaaaaaanaaacacacagacaaaacaagccaaacaaataaacaagagcaaaaagagacgcagacacaacacacgacacacgcagaacaagcagcaaaacaaacaagagcagacaaagaaaaaacaaggagggggggcggcgcacaaataaaacacacgagaggaggacacaagacagcacacacgagagaacattacgaagcagacgacgagacaccgcgacgcg

SEQ ID NO: 439302 - DNA, 580 bp, Homo sapiens
actcatctccccaaacttagcatctagttagagttcattaaaagtgccttctaatgctttctatccatgaagctctaatatttttttctatgcgtatgataaatatgaactcttactatataggaatatggttgtttatgctggtgtggaagagcagcctaagcttggcagaagcagggaggatatgacagaggtaagcattccatttcaccatggttcaaatgcatcttgttttgggccactgatttatctcaacctcacttcagttcttcttcttcttttttttcttaatacaatttgtgtttttctgtatagcactgcataaatattggtgactatgtaatccattctcctcaaccccttcatactagtgccagttgacatagatgttgatgtatctaagactgagttactaccccattcagccctccgttggctactgctttatgtaatttgctgctcatttcttgtatcagttctgatacaagcgttttgaaggaaaagttaatgactgatttttagttttctattgcatataaattatgggatctccgtaaatgcatgttggtagatttcagtt

SEQ ID NO: 439303 - DNA, 399 bp, Homo sapiens
atttttaatgttactcgactaactttataagtatctgctcaaagagatgctattgttctttttgataattgttgctggccttaaagtgcctgggagggttatcgaactctcatcaattggttgtgaaagctaatttctgatggaaacacccagattttggtctgtctgctgcttgtgttttgatgtaaaagtattttagtaaaaattatttgaagttttaagccactgtgttgataaatatggtgtgtggtcattgctgcctaccttgtaaagactgaaaacaatttgttcttttcccagtgtaacctttttttccctttagttcataccagagacagcgaaatgagggcaaaggaaagagtagattaaggagtttaggtagttaatccttgcagttcc

SEQ ID NO: 439304 - DNA, 6451 bp, Homo sapiens
accgtagaggatcccctagtgtggaaagcgagtgagaggtgtcggggatggttgctctttgtccagagggctggacccttagctctgtcctcgctggagctgtccccgagcggtgatcccagggtcgtgacagagcctgtgaagtactcaagccgtcctccctgccactttcctacgggacttcccgggtctttaccatccctctacgtcgctccctagaggtagttggagagctaggggtaccgagcgcgagttcggagtcggggtcgtgggggttcgctgtgtagaaatggattgccgtaaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 439305 - DNA, 6431 bp, Homo sapiens
  misc_feature (57)..(57): n is a, c, g, or t
  misc_feature (76)..(76): n is a, c, g, or t
taggcggaagtgacgtgagaggttcggggatggttgcctttgtccagagggctgganccttagctctgtcctcgcnggagctgtcccgagcggtgatcccagggtcgtgacagagcctgtgaagtactcaagccgtcctccctgccactttcctacgggacttcccgggtctttaccatccctctacgtcgctccctagggagagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 439306 - DNA, 4399 bp, Homo sapiens
gcttaagctcagaaaatgtgtttgatttcaaaaaacaattaattattagaatgcagttaaagtgacaatcctaaaattaattaaagtcatttagagaaacactatgttagtggccaaacattgaactttgcattaatgattggttcttgttcttttaaccgaaatatcttcaactattttttccctccttttagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 439307 - DNA, 6407 bp, Homo sapiens
accgtagaggatcccctagtgtggaaagcgagtgagaggtgtcggggatggttgctctttgtccagagggctggacccttagctctgtcctcgctggagctgtccccgagcggtgatcccagggtcgtgacagagcctgtgaagtactcaagccgtcctccctgccactttcctacgggacttcccgggtctttaccatccctctacgtcgctccctagaggtagttggagagctaggggtaccgagcgcgagttcggagtcggggtcgtgggggttcgctgtgtagaaatggattgccgtaaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaactacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 439308 - DNA, 7464 bp, Homo sapiens
  misc_feature (7247)..(7247): n is a, c, g, or t
accgtagaggatcccctagtgtggaaagcgagtgagaggtgtcggggatggttgctctttgtccagagggctggacccttagctctgtcctcgctggagctgtccccgagcggtgatcccagggtcgtgacagagcctgtgaagtactcaagccgtcctccctgccactttcctacgggacttcccgggtctttaccatccctctacgtcgctccctagaggtagttggagagctaggggtaccgagcgcgagttcggagtcggggtcgtgggggttcgctgtgtagaaatggattgccgtaaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctgactggctgttttttccctgtattctttacaactattttttgaccctctgaaaattattatacttcacctaaatggaagactgctgtgtttgtggaaattttgtaattttttaatttattttattctctctccctttttattttgcctgcagaatcgttgagagactaataaggcttaatatttaattgatttgtttaatatgttatataaatgtaaaagagtgtataaactgtagagatagcattggcaagacattgtacagatgcaaccttttacacaacatcattgtgtaatttgtaaagattcacgtgtagttctttattatagtgattttgggctttgtacccactgaatgccattttttgtgtttttaaattattttctttatcttgttacaaaaactgagatgtggggttttttttttttcagttcacttatcattagaatgtctgaacttttatgtaacatttttgtgtgcatctctcaatgctaacaccacatgtttgcctatgacaagtttatagagtgaaaggtatcttctgggttgaaataattcacaaattggtgaatgtcatcttgcaacacaccctgtacagtcttccttaaaggaacactacagtatatttttagtatctacatgctgaatgactgaatacagacctaagcacagcagtggtcctggtacagtatttaagtgtcggcatacacaggcgtaatccctgtataaagtagtgccaaactgatttcagttgtgtaactagtttaaaacccaataaatggattctttttaaaaaaanaaacacacagacaaaacaagccaaacaaataaacaagagcaaaaagagacgcagacacaacacacgacacacgcagaacaagcagcaaaacaaacaagagcagacaaagaaaaaacaaggagggggggcggcgcacaaataaaacacacgagaggaggacacaagacagcacacacgagagaacattacgaagcagacgacgagacaccgcgacgcg

SEQ ID NO: 439309 - DNA, 1885 bp, Homo sapiens
ggacagcatccctaagccaggcaggtgtgttaggcctgggctcacgcgcctgccactcgctcacataagcggccgtcccgcgaaaaggtgacaccgtgtcaggggacctcagtctgagtgtgacagactgtactcatcaaactatactcctaggccaaatccaagtattttaaattttattttgggtgctgttatactgcttcttaataagtgtctaatttatgaagtaacatagatgatatctttcatagcaccgaagagctgtcagagtggctgtatgacaataacattacaatattgttctactttgtggtctgtaaatgaatggcaaagacttactctgcatctttgttttcaaaatagtattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 439310 - DNA, 1498 bp, Homo sapiens
gtgtccctcacagaactgttagaaggatgaaatgacatacctgtaaagcagaaagcacagtgattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 439311 - DNA, 837 bp, Homo sapiens
aggtgaattgctgcttgttctcaccgatcttcttgtgtcatctttctatgcataatagcatggtgacacaagaagatcggtgagaacaagcagttggtcatcatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 439312 - DNA, 5687 bp, Homo sapiens
accgtagaggatcccctagtgtggaaagcgagtgagaggtgtcggggatggttgctctttgtccagagggctggacccttagctctgtcctcgctggagctgtccccgagcggtgatcccagggtcgtgacagagcctgtgaagtactcaagccgtcctccctgccactttcctacgggacttcccgggtctttaccatccctctacgtcgctccctagaggtagttggagagctaggggtaccgagcgcgagttcggagtcggggtcgtgggggttcgctgtgtagaaatggattgccgtaaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggtaaaatttaagttatagaaaacggaaattcagtcaatttaaagaaaccatcatggttccctttttaataagtatttgcggccaggtgcaattgtttatatttataacctcaactctttgagagacgaagtcagtgagatcacttgatgccaggagtttgagaccagcctggacaacgtagcaagactgtctctacaaaaagtaccaaaattagctggacatgatggtgtgcacctgtgatcccagctattcaggaggtcgaggtcggaggatcgcttaagcctggaggttgagcctgcagtgagctgtgattgtaccactgcattcatcctgagcagcagagtagaccctgtctcaaaaaaattaaataaaaataactttaatttt

SEQ ID NO: 439313 - DNA, 4499 bp, Homo sapiens
accgtagaggatcccctagtgtggaaagcgagtgagaggtgtcggggatggttgctctttgtccagagggctggacccttagctctgtcctcgctggagctgtccccgagcggtgatcccagggtcgtgacagagcctgtgaagtactcaagccgtcctccctgccactttcctacgggacttcccgggtctttaccatccctctacgtcgctccctagaggtagttggagagctaggggtaccgagcgcgagttcggagtcggggtcgtgggggttcgctgtgtagaaatggattgccgtaaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggtaagcattccatttcaccatggttcaaatgcatcttgttttgggccactgatttatctcaacctcacttcagttcttcttcttcttttttttcttaatacaatttgtgtttttctgtatagcactgcataaatattggtgactatgtaatccattctcctcaaccccttcatactagtgccagttgacatagatgttgatgtatctaagactgagttactaccccattcagccctccgttggctactgctttatgtaatttgctgctcatttcttgtatcagttctgatacaagcgttttgaaggaaaagttaatgactgatttttagttttctattgcatataaattatgggatctccgtaaatgcatgttggtagatttcagtt

SEQ ID NO: 439314 - DNA, 1267 bp, Homo sapiens
  misc_feature (57)..(57): n is a, c, g, or t
  misc_feature (76)..(76): n is a, c, g, or t
taggcggaagtgacgtgagaggttcggggatggttgcctttgtccagagggctgganccttagctctgtcctcgcnggagctgtcccgagcggtgatcccagggtcgtgacagagcctgtgaagtactcaagccgtcctccctgccactttcctacgggacttcccgggtctttaccatccctctacgtcgctccctagggagagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacgtaagtgtgcccgggcctgcgggccgggccggggggaaaggctcagtgagaggtgtcggggatggttgctctttgtccagagggctggacccttagctctgtcctcgctggagctgtccccgagcggtgatcccagggtcgtgacagagcctgtgaagtactcaagccgtcctccctgccactttcctacgggacttcccgggtctttaccatccctctacgtcgctccgcatctgcttctcccgaagtgttcgggttgttgtcttcccacctggggggccctgggtagcccaagggccccggccccgagggagagaggtgagcctttctcaagggtcctccgtggacttttgcgcatgggagaggcggggcaaagagaatttgtctttgggggagttccttgacttgtctccttgcttcctccggttcttccttcccctacgatccccgcctcttcgcatctccgttggcgtctagtaactttctgaatggagagaagacccatagggaaacttaagggttttgctttttgggggccctctcagacctggcggagttgatcgaaaagggtcgtttaaagtcagacctcattcttgagcttaacgtcttatgtggacagtgttgttttggattgtgtgttgctcctgttgtgacatttcttttggagagacatttaagatactgaggaaagtagggaagagcactgtcaggatgtccagggcgatattagtatcaggcttgtgttaattttttgagttactcagattaagagattacctaaatcagtttcaggagttctgtttgtaaactagcttcaaactatagtgtcactgaaattaggaaaa

SEQ ID NO: 439315 - DNA, 391 bp, Homo sapiens
ccctttagttcataccagagacagcgaaatgagggcaaaggaaagagtagattaaggagtttaggtagttaatccttgcagttccgtttgtatgaaagggaaggctcaattattacatgtaaacaaataatacctgaatgtgtgaggttatcttatagatatttattaattgaattagatatgttcttaaaatacaccaatctaattatcaaatggctttccccccccagttctgtagaaaatattctcaaaacactcgtgaaaagctgccgaccgtaagtagcttctcaatttataaagcctcttgttgtttctgtgggcttttccacatctttagtatggtttgaaaaggaaatgaaaagtataaatagttcctgacattgtgatgtta

SEQ ID NO: 439316 - DNA, 276 bp, Homo sapiens
gtcctttttgtttactttcagcaactagtaaatctctttgctcgattggctacagataatatagggtacatagattgggatccatatgtaccaaaggtaattaacattttggggaaaaaaattatcaggcatggggtggtaggcgcctgtaatcccagctgctcgggtggctgaggcaggagaatctcttgaacccaggaggctgaggttgcagtgagccaagattgcagtactgcactccagcctgggtgacagagcttgactccatctggaaaa

SEQ ID NO: 439317 - DNA, 522 bp, Homo sapiens
taaaggaaaatacatcttattcttggttgcctcctgggtggggctgggacattttgtgtggccctgaggactctgggttctaaaagttgtgagaacttgatctggattcttacacccattctgttaaagagggagtacccagaagcctttctactggaataggaagaataaaaatttcatttattaggcttttagagttggatgtcttgttacctaattgaaattttttcctccctgatacagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatga

SEQ ID NO: 439318 - DNA, 202 bp, Homo sapiens
caggtagttgcgtttcttctcatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccagtgagtggataaaattagtagaacctc

SEQ ID NO: 439319 - DNA, 6887 bp, Homo sapiens
  misc_feature (57)..(57): n is a, c, g, or t
  misc_feature (76)..(76): n is a, c, g, or t
taggcggaagtgacgtgagaggttcggggatggttgcctttgtccagagggctgganccttagctctgtcctcgcnggagctgtcccgagcggtgatcccagggtcgtgacagagcctgtgaagtactcaagccgtcctccctgccactttcctacgggacttcccgggtctttaccatccctctacgtcgctccctagggagagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacgtaagtgtgcccgggcctgcgggccgggccggggggaaaggctcagtgagaggtgtcggggatggttgctctttgtccagagggctggacccttagctctgtcctcgctggagctgtccccgagcggtgatcccagggtcgtgacagagcctgtgaagtactcaagccgtcctccctgccactttcctacgggacttcccgggtctttaccatccctctacgtcgctccctagaggtagttggagagctaggggtaccgagcgcgagttcggagtcggggtcgtgggggttcgctgtgtagaaatggattgccgtaaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 439320 - DNA, 6431 bp, Homo sapiens
accgtagaggatcccctagtgtggaaagcgagtgagaggtgtcggggatggttgctctttgtccagagggctggacccttagctctgtcctcgctggagctgtccccgagcggtgatcccagggtcgtgacagagcctgtgaagtactcaagccgtcctccctgccactttcctacgggacttcccgggtctttaccatccctctacgtcgctccctagaggtagttggagagctaggggtaccgagcgcgagttcggagtcggggtcgtgggggttcgctgtgtagaaatggattgccgtaaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 439321 - DNA, 6295 bp, Homo sapiens
accgtagaggatcccctagtgtggaaagcgagtgagaggtgtcggggatggttgctctttgtccagagggctggacccttagctctgtcctcgctggagctgtccccgagcggtgatcccagggtcgtgacagagcctgtgaagtactcaagccgtcctccctgccactttcctacgggacttcccgggtctttaccatccctctacgtcgctccctagaggtagttggagagctaggggtaccgagcgcgagttcggagtcggggtcgtgggggttcgctgtgtagaaatggattgccgtaaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaagttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 439322 - DNA, 6397 bp, Homo sapiens
accgtagaggatcccctagtgtggaaagcgagtgagaggtgtcggggatggttgctctttgtccagagggctggacccttagctctgtcctcgctggagctgtccccgagcggtgatcccagggtcgtgacagagcctgtgaagtactcaagccgtcctccctgccactttcctacgggacttcccgggtctttaccatccctctacgtcgctccctagaggtagttggagagctaggggtaccgagcgcgagttcggagtcggggtcgtgggggttcgctgtgtagaaatggattgccgtaaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 439323 - DNA, 1325 bp, Homo sapiens
ggaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacgttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctga

SEQ ID NO: 439324 - DNA, 5423 bp, Homo sapiens
accgtagaggatcccctagtgtggaaagcgagtgagaggtgtcggggatggttgctctttgtccagagggctggacccttagctctgtcctcgctggagctgtccccgagcggtgatcccagggtcgtgacagagcctgtgaagtactcaagccgtcctccctgccactttcctacgggacttcccgggtctttaccatccctctacgtcgctccctagaggtagttggagagctaggggtaccgagcgcgagttcggagtcggggtcgtgggggttcgctgtgtagaaatggattgccgtaaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgcctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggagaaaatatactgcaggccgggcacagaggcttacgcctgtaatcccagcactttgggaggccaaggcaggaggattgcttgagcccacgagttggagatcagcctgggcaacaaaaaaaaaagt

SEQ ID NO: 439325 - DNA, 3331 bp, Homo sapiens
accgtagaggatcccctagtgtggaaagcgagtgagaggtgtcggggatggttgctctttgtccagagggctggacccttagctctgtcctcgctggagctgtccccgagcggtgatcccagggtcgtgacagagcctgtgaagtactcaagccgtcctccctgccactttcctacgggacttcccgggtctttaccatccctctacgtcgctccctagaggtagttggagagctaggggtaccgagcgcgagttcggagtcggggtcgtgggggttcgctgtgtagaaatggattgccgtaaacaagctgctgccctacgcggagcggctagacgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcgggtcagtattttcacctaaaagtctgcactaattgttttaaagtcgtataataacctcgtaatttgggtattattcagcatatagaagaagttttcctaaaaggaaaaatagtagatttaaaagtatgtaaaagttaaaaacatcatggtagaaatcaaatggatcctagcaaaaaatatatttttcttatacagaatcttctgcctgtttccatgacagtctctaaactctcaatgggaatttggacaatagcattgagactaccttgtaagaacttgaaggaatttaaaaataggaggaattatctatgggcatgaatttaaagcattacactttatgtagatctg

SEQ ID NO: 439326 - DNA, 800 bp, Homo sapiens
  misc_feature (768)..(768): n is a, c, g, or t
  misc_feature (777)..(777): n is a, c, g, or t
agatatctacgtctaggaagaggagggggcataggcattccatgtaaacttaacacctgggttacgatctggaaggatgaaaaagcatggctttttttggccaggcgcggtggctcacgcctgtaatcccagcactttgggaggctaaggcgggcggatcacgaggtcaggagatcgagatcatcctggctaacacggtgaaaccccgtctctactaaaaatacaaaaaattagctgcgcgtggtggtgagcgcctgtagtcccagctactggggaggctgaggcaggagaatggcgtgaacccaggaggtggagcttgcagtgagctgagatagtgccactgcactccagcctgggcggtaaagcgagactccatctcaaaaaaaaaaaaaaagaaaaagcatggctttttaaaaattcttggccctttgtcctctctgggattggagtttgggacatagagtggctggatgggcaggtagggtagaagcctggcatttgtgtccacacttggtggggctgtctctcactcagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcagggaatgcccccatcttgggtttgacttgccactgccacntggcctgangtactggtatgcctttggcttct

SEQ ID NO: 439327 - DNA, 565 bp, Homo sapiens
ccaagcctcagcttcctatgtgtaaaatgagcccagttcctgacatgtagtagattctcagtaaatgatatgaggagagcccagaaggcgttgttgacctcactcgagggattggggttgggagggaagtcggctgtacttagggaaataaatggttcctggcctcttgatctcagttcagactgcaaactcttaggggcaggggtagctacatatcaggctatgggtttggtgctagaatggtgttgatactgtggtgttctctgaggatggggatcccagccaatgccatctggcatagtgctgtacacaggtgagtttgtttaggaagatttggggaagatgcctggagtctttggaatggcaactcctgctgatggagtaatctatctgtctctctttccaggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439328 - DNA, 339 bp, Homo sapiens
gccctgactctacctggctaaaaaggcagtgttgtggaaccccagcttctgctcacaaagctggctttcttgaaccccactctccatcctcaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439329 - DNA, 398 bp, Homo sapiens
ctggagggagcccactgtaggcatatttcccatttcagcagggctcaggtgctccaggagcttagggaagctgcatggggaactaaatagtgcttatgaatactgaccccttttcctcatcgctgggcctgtccaacttcaacagtcggcagattgatgacatactcagtgtggcctccgtgcgtccagctgtcttgcaggtaaggacagcaagcagatgagtggtttaggggttgtctgctcaagagcatgagggagcagacgatggatctgcttaagggagatagctagcaagttgtcagagtgttggtgcagaagtcctctgcataaaggtgggcattgaagcagtgggagagaatgaaattgccgatgggaaatggtgagaaaagcaggctgaa

SEQ ID NO: 439330 - DNA, 1457 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439331 - DNA, 1585 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtttcaagtgatcctcccgcctcagcctgcccaggtgctgagattacatgtatgagccactgcacctggaaaggagccagaaatgtgaagtgctagctgaaggatgagcagcagctagccaggcaaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439332 - DNA, 1479 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatccaatcagagaattgcttgcttgtc

SEQ ID NO: 439333 - DNA, 1496 bp, Homo sapiens
ggccagcaaaaggcgaggctggccccgccccttgcaccgcccacgtggccagcgccacctgcctcattgtgcccaggagttctccaaacccgcgctgcggagtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtttcaagtgatcctcccgcctcagcctgcccaggtgctgagattacatgtatgagccactgcacctggaaaggagccagaaatgtgaagtgctagctgaaggatgagcagcagctagccaggcaaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439334 - DNA, 1285 bp, Homo sapiens
ggcccaagggggcctttggggattaacccggggggttcaccccgggggaattaccgggatcgctctgtgcttgtgccaaggtttcaagtgatcctcccgcctcagcctgcccaggtgctgagattacatgtatgagccactgcacctggaaaggagccagaaatgtgaagtgctagctgaaggatgagcagcagctagccaggcaaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439335 - DNA, 1721 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtatggggcagtcttagggagagggccctgggttgggaggcaagggttaagggatttcttatttcagtgtctgggtgaggctgaggatcttgccttgtgatctggagggaggccactgtaggcatatttcccatttcagcagggctcaggtgctccaggagcttagggaagctgcatggggaacaaaatagtgcttatgaatactgaccccttttcctcatctgtctaatcccccaacttaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatccaatcagagaattgcttgcttgtc

SEQ ID NO: 439336 - DNA, 1367 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439337 - DNA, 1257 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439338 - DNA, 1388 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439339 - DNA, 1320 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439340 - DNA, 1248 bp, Homo sapiens
agatatctacgtctaggaagaggagggggcataggcattccatgtaaacttaacacctgggttacgatctggaaggatgaaaaagcatggctttttttggccaggcgcggtggctcacgcctgtaatcccagcactttgggaggctaaggcgggcggatcacgaggtcaggagatcgagatcatcctggctaacacggtgaaaccccgtctctactaaaaatacaaaaaattagctgcgcgtggtggtgagcgcctgtagtcccagctactggggaggctgaggcaggagaatggcgtgaacccaggaggtggagcttgcagtgagctgagatagtgccactgcactccagcctgggcggtaaagcgagactccatctcaaaaaaaaaaaaaaagaaaaagcatggctttttaaaaattcttggccctttgtcctctctgggattggagtttgggacatagagtggctggatgggcaggtagggtagaagcctggcatttgtgtccacacttggtggggctgtctctcactcagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439341 - DNA, 1385 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtttcaagtgatcctcccgcctcagcctgcccaggtgctgagattacatgtatgagccactgcacctggaaaggagccagaaatgtgaagtgctagctgaaggatgagcagcagctagccaggcaaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439342 - DNA, 1167 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439343 - DNA, 996 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctctcatcaggatcacgccatgcagtcgacgcggccgcgaatttagtagtagta

SEQ ID NO: 439344 - DNA, 1048 bp, Homo sapiens
agatatctacgtctaggaagaggagggggcataggcattccatgtaaacttaacacctgggttacgatctggaaggatgaaaaagcatggctttttttggccaggcgcggtggctcacgcctgtaatcccagcactttgggaggctaaggcgggcggatcacgaggtcaggagatcgagatcatcctggctaacacggtgaaaccccgtctctactaaaaatacaaaaaattagctgcgcgtggtggtgagcgcctgtagtcccagctactggggaggctgaggcaggagaatggcgtgaacccaggaggtggagcttgcagtgagctgagatagtgccactgcactccagcctgggcggtaaagcgagactccatctcaaaaaaaaaaaaaaagaaaaagcatggctttttaaaaattcttggccctttgtcctctctgggattggagtttgggacatagagtggctggatgggcaggtagggtagaagcctggcatttgtgtccacacttggtggggctgtctctcactcagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439345 - DNA, 869 bp, Homo sapiens
gggggtggtccagacatgcatgtctgggatgggccaagcaagctgggtgtcaccacttcatggtgatgggttattctttggctcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtatggggcagtcttagggagagggccctgggttgggaggcaagggttaagggatttcttatttcagtgtctgggtgaggctgaggatcttgccttgtgatctggagggaggccactgtaggcatatttcccatttcagcagggctcaggtgctccaggagcttagggaagctgcatggggaacaaaatagtgcttatgaatactgaccccttttcctcatctgtctaatcccccaacttaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatccaatcagagaattgcttgcttgtc

SEQ ID NO: 439346 - DNA, 313 bp, Homo sapiens
gcctgcccaggtgctgagattacatgtatgagccactgcacctggaaaggagccagaaatgtgaagtgctagctgaaggatgagcagcagctagccaggcaaaggtagggtttggggaaggaaagtgcacacacctagagtcaggtaagtgatgtgaccctgttgagtgttcaaagtctggaatacagtctgacatgaggaggtggtgaaatgagaaagatagaagccaggttttgagaagcctggactttatcctgaatataggggagaattgctggaagggtttgagactgggagtcacatggttggatct

SEQ ID NO: 439347 - DNA, 1368 bp, Homo sapiens
ggccagcaaaaggcgaggctggccccgccccttgcaccgcccacgtggccagcgccacctgcctcattgtgcccaggagttctccaaacccgcgctgcggagtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439348 - DNA, 1606 bp, Homo sapiens
  misc_feature (1469)..(1469): n is a, c, g, or t
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatccaaaaaaaaaaaanaaaaaaaccagagggaatcaatggccgggggggcgaaacgcggtcaggactggcactggtcaacgggtccgaccaggttcctggcacaggggcagcggcgggcacaaaggggcagataacgaagccggtaccgtagc

SEQ ID NO: 439349 - DNA, 1517 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatccaagcacagacccacgagcctcaagcaccaaccccgcgggaccataaggggtgggacaaagc

SEQ ID NO: 439350 - DNA, 1189 bp, Homo sapiens
aagcagtggtatcaacgcagtgtggccattacgccgggagccactgcacctggaaaggagccagaaatgtgaagtgctagctgaaggatgagcagcagctagccaggcaaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439351 - DNA, 1086 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctctcatcaggatcacgccatgcagtcgacgcggccgcgaatttagtagtagta

SEQ ID NO: 439352 - DNA, 1402 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcagctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439353 - DNA, 1436 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtttcaagtgatcctcccgcctcagcctgcccaggtgctgagattacatgtatgagccactgcacctggaaaggagccagaaatgtgaagtgctagctgaaggatgagcagcagctagccaggcaaagggggcaatggcggcttcctgtgttctactgcacactgggcagaagatgcctctgattggtctgggtacctggaagagtgagcctggtcagatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439354 - DNA, 1177 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcagggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439355 - DNA, 1160 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagtgagccttgccagagcctcatctggggaatcagggggttgagcaggatggtgttagtaacttattgtaagtcacagcagcagagcaggataggaacactcatttgcatgccaagctgaggagcttgacatgggatcttagcctcttctgctacagcagcttagctgtagctacaggagtttaactctggaaaaaggaaggcagtctcacatggtgtgtaccccagggtatgcacctgtaaccctcctgctccctttattcatttagaaaaggtgctgacttttctgttgagcacctggggttacagtaataagtaagtctcagcagaagatgtgagaagagctcaccattagtgccgtgccctgtgctggaagaagggtggataactccctgaggatgagttaaggaagacttccta

SEQ ID NO: 439356 - DNA, 482 bp, Homo sapiens
gcggccgcctactactactactactgctcgaattcaagcttctaacgatgtacggggacgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439357 - DNA, 865 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcagctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 439358 - DNA, 1070 bp, Homo sapiens
ggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagtgagccttgccagagcctcatctggggaatcagggggttgagcaggatggtgttagtaacttattgtaagtcacagcagcagagcaggataggaacactcatttgcatgccaagctgaggagcttgacatgggatcttagcctcttctgctacagcagcttagctgtagctacaggagtttaactctggaaaaaggaaggcagtctcacatggtgtgtaccccagggtatgcacctgtaaccctcctgctccctttattcatttagaaaaggtgctgacttttctgttgagcacctggggttacagtaataagtaagtctcagcagaagatgtgagaagagctcaccattagtgccgtgccctgtgctggaagaagggtggataactccctgaggatgagttaaggaagacttccta

SEQ ID NO: 439359 - DNA, 2448 bp, Homo sapiens
  misc_feature (2448)..(2448): n is a, c, g, or t
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttggaaaaaaaaaaaaataaaagcagacaaaagaacgcgcggagcatcaaatacagcgggtgcacgaaacaaagcagggacaaaaaaggcgccacggtggcatatgcagtggttacgacgaacccaacgtttcgtgggcacaaagcgggcgaaactacgtcaggccacccaaaaggggagcggcaatagttgagaagcagggtacccggcttagaggagcgccaacn

SEQ ID NO: 439360 - DNA, 172 bp, Homo sapiens
tcggaacgcgccatggtgttggtaccgggaatcgcggccgcgtcgaccttctccctaagtgctctaacctcgctgaactatgagcctgaagggtgggtcgatgccagaccttaggtggaggccaaagacagtacagaataaacagcttcttcctaaattgaccccaacttga

SEQ ID NO: 439361 - DNA, 2582 bp, Homo sapiens
  misc_feature (1461)..(1461): n is a, c, g, or t
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccntggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcgggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttgga

SEQ ID NO: 439362 - DNA, 2955 bp, Homo sapiens
  misc_feature (1461)..(1461): n is a, c, g, or t
  misc_feature (1857)..(1857): n is a, c, g, or t
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccntggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcggtgagacaagccccgctccggaaacgcactcagtttcctccatcttgtttcgtccccctcgacacccttcagcatcccccaccctgcgtccacccncattcctcccacccagtccacacccttcatttctcgcgacccataccctctttgctcaaactgcagcctgtcttcccaggcttccgccttcaccgtcttcctccgctgtctcctgttcaggctaatccactcatttcccccctctcatttcccccagacttttgcctcgattccctttttctctctgtcatctcgaaccctcctgccctttctcatttctttccttcctggagcctcccatgccctaatcccatcctttttcctcatatcgctgtagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttgga

SEQ ID NO: 439363 - DNA, 3061 bp, Homo sapiens
  misc_feature (1461)..(1461): n is a, c, g, or t
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccntggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcgggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttggattttgagcatctttttcctggtacacacagaaaaacattttataatggaagtcggtttcttggccatctacatagttttctgggcagcgccaagcagggaggtgtctccagttgtgagtcctcggacaggctgctgcatgggtgcacatactcacgttattggtggaagttttaagtcccaaactgaagggaaggaggcctaggtggcacaatcagggaggaatatacatctgagaagttttgggaagacatcacctggcaaggctgcctgaaccacagtaatttagtcttcctctatccagatcactgagagttgtgtgctggtcttctctcaaaccctggatgtgttacctgcttctccctaagtgctctaacctcgctgaactatgagcctgaagggtgggtcgatgccagaccttaggtggaggccaaagacagtacagaataaacagcttcttcctaaattgaccccaacttga

SEQ ID NO: 439364 - DNA, 3224 bp, Homo sapiens
  misc_feature (1461)..(1461): n is a, c, g, or t
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccntggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcgggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttggaacaaaaaaacaaaacaaacaaaacacacaaaacaaaaaaaagaaaaacaacaggacgggggagcgcgcatagagaaataccacggggaggggcacacaccggtaagcgcagagaagccagaacattgagggatacagaggcgggaaccccacagaagagagagagcacatatcaacacgaaacagcgggagcggggccccgcgcaagacagaaacacaaaagacaggcgcggaggcgaagagggagcgaacaacgcgcgcgacacgagaagccggggacacacacccgcgacgcaaagaacacaaaacaactacaatcgaagtcgggccgggcgaggtagcaaaacaactagcgggcaggccaacaaacacacaaacatagcaggcacatcaagtaacagacacgcaccaagaaagggaaagacacacaagccgaaaacacaaataagacgaaaagcagcgaacagacacgaggggcgagccaccgcccaacgacgcgaagacaaatcgagcaggaggcggcgcgcaaaaagcaaaaacaaaaggccggcagacgcagccagaccaaagtgacacacacacgagcagacaacaatcccaataccacaaccagcgggagagacagacagacacaaccacaaca

SEQ ID NO: 439365 - DNA, 2695 bp, Homo sapiens
  misc_feature (1574)..(1574): n is a, c, g, or t
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtaggcgggggcttccaggagggaggagagaccgcgcctgggcactggccgccgccctgcgaccgcgacgggaaacgcacaggagcggagcggagggaaacgcagggtcgcaggagcgagaccctgaccaaagtctgcgacctcaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccntggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcgggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttgga

SEQ ID NO: 439366 - DNA, 2091 bp, Homo sapiens
  misc_feature (970)..(970): n is a, c, g, or t
gctgggattacaggcgtgagccaccgcgcccggccagccctgtggacttctaagccagcgagtgcctcttctgctgccctaaaccacacttagcctcctttccacccctgcaggtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtaggcgggggcttccaggagggaggagagaccgcgcctgggcactggccgccgccctgcgaccgcgacgggaaacgcacaggagcggagcggagggaaacgcagggtcgcaggagcgagaccctgaccaaagtctgcgacctcaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccntggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcgggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttgga

SEQ ID NO: 439367 - DNA, 1081 bp, Homo sapiens
  misc_feature (26)..(26): n is a, c, g, or t
agcaggctggtacggtccgaggctangatcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcgggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttgga

SEQ ID NO: 439368 - DNA, 2004 bp, Homo sapiens
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtaggcgggggcttccaggagggaggagagaccgcgcctgggcactggccgccgccctgcgaccgcgacgggaaacgcacaggagcggagcggagggaaacgcagggtcgcaggagcgagaccctgaccaaagtctgcgacctcaggtgcaggaggggtccgcgcgtcccccttcggccgtggcttgcgaggactgcagctgcagggacgagaaggtggcgccgctggctccttgacgcgctcccgggcctcagcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttgga

SEQ ID NO: 439369 - DNA, 2766 bp, Homo sapiens
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttggaacaaaaaaacaaaacaaacaaaacacacaaaacaaaaaaaagaaaaacaacaggacgggggagcgcgcatagagaaataccacggggaggggcacacaccggtaagcgcagagaagccagaacattgagggatacagaggcgggaaccccacagaagagagagagcacatatcaacacgaaacagcgggagcggggccccgcgcaagacagaaacacaaaagacaggcgcggaggcgaagagggagcgaacaacgcgcgcgacacgagaagccggggacacacacccgcgacgcaaagaacacaaaacaactacaatcgaagtcgggccgggcgaggtagcaaaacaactagcgggcaggccaacaaacacacaaacatagcaggcacatcaagtaacagacacgcaccaagaaagggaaagacacacaagccgaaaacacaaataagacgaaaagcagcgaacagacacgaggggcgagccaccgcccaacgacgcgaagacaaatcgagcaggaggcggcgcgcaaaaagcaaaaacaaaaggccggcagacgcagccagaccaaagtgacacacacacgagcagacaacaatcccaataccacaaccagcgggagagacagacagacacaaccacaaca

SEQ ID NO: 439370 - DNA, 1122 bp, Homo sapiens
agcaggctgtactggtccgaatttttagatggcaggtgatggcggcgctggtcgtatccggggcagcggagcagggcggccgagacggccctggcagaggtgggtgctggaacgctgcgccctccagacctcgcatctcggggcggggcccccaagttagggacaggaccaaccccctttaacggcggcggcgcctttctccgctagatcccgctgttagtcgccttgggccgctgtcaccagctcggggtcgctgtcagccggagcccaggggtaccagtcttttgcagctttagggcacgaccgagagcagcccttaatcctccaatcggaaactacagccttgtcttggcgggtagacggataaaatggactcgacggggagggaaagggccaggccagatgcagcgggcattttacgagtgcgccctcagggaatgctttcagggaagaggcaaaaggtttcattcgccaggcattaactgagcgcccaccgaatgccaggcctgcgctgggtgcaggtactagaatcagagatctcagtctactgggggaatgttaatgtaaacatatcatagccacgtgataaaggaggaggtgcctactggtccctgggacacattgaagggctaatgttagcagttccttacacgccagcgaccactagggacctgtcagaggaggatctgtaatgggcctaggaagcctaggctgattgtccaaggcttttgaaacaactggccaaaaaccatagcagtggtaacgttcaaatctgatctcagggccccagcctccgctggaccatccccaccgccgcccacacagtgggtgaagcctcatgtctgggcgggtccctcctatcatagtgtggggccctagcagaagttgtggcacatagcacagtctcaatacatattcgttgaataagttaatttcttgccttttcatatcctcagactctgtggctcctgaagagataacggggttgaactaagcttaattgtcggggcagggcatagtggcttacacctttagtctgagcactttgggaggctaaggaggattgtgtgagcccaggaattccacaccagtctgggaaacatagggggaccctgtatgcac

SEQ ID NO: 439371 - DNA, 852 bp, Homo sapiens
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgagtatggtggggccaggacacctggacggtggcggggctggcagggaggcaggctgcacattcatcttccccatggcagtgccttcttgtcctgcttggagacacaaggtccctcctggtttctggggtggcctctgccttcccgctctgcaggtagatctttcctttggatttggttgccttggcaacggtgctctgtcccagatgcaggtgtttgaaaggctgttggttgtagagcaggctgggccccggccgggtgacagagaagtctgattgagaaggagcttctaggggatctgtgacccccctcttctcctaccctgtccttttacccccaggctgaagccactgcgcctggctgctcagagacctgagcctggccg

SEQ ID NO: 439372 - DNA, 500 bp, Homo sapiens
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtggatcactggtttttcacattggcttctgtcacttagtaatatatgtttaagtttcttctacgtattttcatgtttttagcttatttctttttagca

SEQ ID NO: 439373 - DNA, 561 bp, Homo sapiens
gccagggcagtcctaagatcctggaggtcagtgggctcaggacagcctctggaggagggaagtgactgggaacacagctgggaaaaccagtaggccacaggttcagctttggctgcttgaccaggtgacccccaccctgcctccctctcccaacagcacctggaatctcgactccgagccttgggcctttcctttgtgaggctgctgctctctgagatcttccccagcaagcttagcctacttcccgaggtggatgtgtgagtatctgcctggctatgactggctaaagaagcttagaagctgggtcttgcccagctcgtcttgaaggctggagccaacaggaattgcttccatggtcatggaattttactgtttacagagacctccctgggagggctaactgggtcatacctgctttgggactttggggctcagaggcaatggcaacatcacatttgtccttgtgagatgagtttgagcggtggctgacacctgccctgtaccaggtactaaatgtggttctggggatactatcaccagtgagctgccctggaaagctca

SEQ ID NO: 439374 - DNA, 2226 bp, Homo sapiens
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttgga

SEQ ID NO: 439375 - DNA, 804 bp, Homo sapiens
agcaggctgtactggtccgaatttttagatggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtaagttaaaaatgggggccaagtaagtcctagagacatgcgtgtaccctgggagggagcctgaggttcatcatccaggaaagaaa

SEQ ID NO: 439376 - DNA, 2550 bp, Homo sapiens
  misc_feature (1429)..(1429): n is a, c, g, or t
agcaggctgtactggtccgaatttttagatggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccntggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcgggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttgga

SEQ ID NO: 439377 - DNA, 2635 bp, Homo sapiens
  misc_feature (1461)..(1461): n is a, c, g, or t
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccntggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcgggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttggaaaaaaaaaaaaccaaaaatcactaaattataaaataattacaaaaaaaaaaaa

SEQ ID NO: 439378 - DNA, 2372 bp, Homo sapiens
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtaggcgggggcttccaggagggaggagagaccgcgcctgggcactggccgccgccctgcgaccgcgacgggaaacgcacaggagcggagcggagggaaacgcagggtcgcaggagcgagaccctgaccaaagtctgcgacctcaggtgcaggaggggtccgcgcgtcccccttcggccgtggcttgcgaggactgcagctgcagggacgagaaggtggcgccgctggctccttgacgcgctcccgggcctcagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttgga

SEQ ID NO: 439379 - DNA, 2104 bp, Homo sapiens
  misc_feature (983)..(983): n is a, c, g, or t
agtattccaaacagcagtgggtcactgtctttactttaggattcataaagcctgttaatgaatgggtgtgctgggggcactgtcatgttcttcagcatgctgcctgggcgacgaggaggcccttcctagggtctgacctggcttcccttcccaggtgggtgcaggtggcatgtccacgtctctccattgactggggcacagccttccccaagccgctgctgacaccctatgaggtaacaccaagctctgggagagagtgggctttggacgtggttctcaaaggtgaggtctggagtggagtggggtgggtgggcagcacttcgttatgttcgtagattccggagtctgtctcgatttctccagcggagtcacttcctagctgtgtagccttaggcaaggccctgaaccacacagttcccttctgtggcaggggacagtgtgcccttcacaggccgtcgtgaggactgaattcagtaatccaggggcagaaaaacactggcagatgttattgtccctccctcccctcccctaggcggccgtggctctgagggacatttcctggcagcagccctacccgatggacttctacgctggcagctccttggggccctggacggtgaaccacggccaggaccgccgtccccacgccccgggccggcccgcgcgggggaaggtaggcgggggcttccaggagggaggagagaccgcgcctgggcactggccgccgccctgcgaccgcgacgggaaacgcacaggagcggagcggagggaaacgcagggtcgcaggagcgagaccctgaccaaagtctgcgacctcaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccntggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcgggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttgga

SEQ ID NO: 439380 - DNA, 2493 bp, Homo sapiens
  misc_feature (1461)..(1461): n is a, c, g, or t
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccntggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcgggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctcctgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttgga

SEQ ID NO: 439381 - DNA, 2059 bp, Homo sapiens
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcccgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttgga

SEQ ID NO: 439382 - DNA, 836 bp, Homo sapiens
gcttgaattagcctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtaagttaaaaatgggggccaagtaagtcctagagacatgcgtgtaccctgggagggagcctgaggttcatcatccaggaaagaaa

SEQ ID NO: 439383 - DNA, 851 bp, Homo sapiens
aatagatggttgattttaacactcctctaaataaagaaaatatataatatattcttggagttataaattttatttgcttttaagtaatatctgatcttactagtagtaacttgctatctgaaaacggcatcattcttttggatttttagggcagtcataaaagagaaatgacaaattagtttttttttctgtggagacatgatgtagcagatgatgggactgtcttacataactggatcttttagaactatcgaagattaagtagtaaaatggtataaaaagtttcttgacaatgttattttcccttcccttccctttttccgtctccccaccccaagctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggtaagaatggggaaatttcttagttaaatgctcagtcttataaggatgtgtttactttatatggagagttttcaagtattcggctgatgaactaattaaatttaagattttagaaaatgatttactaatataaaaattacataataggaatgattagaatattgtcatagcagatttaatttaacaagtattagacacctgccatatgtaaaacagtgtgccacccacagaaatatagttaaggtactctatgttcaagattatagtcatcttagaatgtgtacttttaggagggcggggatttttgtttattttgtttactgttacgtttcca

SEQ ID NO: 439384 - DNA, 9795 bp, Homo sapiens
aggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtgaaaaattacttc

SEQ ID NO: 439385 - DNA, 4286 bp, Homo sapiens
  misc_feature (1)..(2): n is a, c, g, or t
  misc_feature (452)..(452): n is a, c, g, or t
  misc_feature (1384)..(1384): n is a, c, g, or t
  misc_feature (3610)..(3610): n is a, c, g, or t
  misc_feature (3885)..(3885): n is a, c, g, or t
nncaaagtagttaagatacttaaacatggtgttcaacttcttattcctccagcttattgattcttgctattggaaagttaccataagatttaaatctcttattctggttcagtaggatgaataaatttagtaacaaaatcttacaagtaaagtaactacatctatccttatttttctttgtttcaggtttcccctcaaaaaacctataaggcatggaagtattttgaaccgagagtcaccaacagataagaagcagaaagttgagcgcattgcatcacatgattttgaccccacaggtaaaacactattcattctttcaaagagtattgagagtagtgaagttcagaataatagagcttaagctacccgaaacactcaggaatagttgtttgatctgttttaggactctcacattcctccaattatatcataataaagcctttgcatttagnaggaatgcaagcatttttaacttccaacactgtacattccactacagaagtatcattgtagagtatattgtatctttaaatagtgataataatagaaatggttatataataattggagatttggtcagatcaagaactcagtgttaagttgaatcatggtataagcagtaatatgtcataaaaccaaggctctaacaactcgacacttgcgtagtcatctaaaaattcaattgtgattatggtgaattggagttttagataaatcagtttcacaaattaatgatggtctcattttagagtaaacaaatgaatagaaatccctttctcttcagtcaaaaagtattctgaacttaaagagctgtctttcaacctaagcagtgtcgatctttcctagggttgtcaccttaacagactttcagattgatctccttttaaaacatctaggctttttccttttgctttctccttgtaagcttactccatatttgattcatagaaagtgcttggtaatcttgcttttttcatttgaaactgatatatattttttgtgcacatactattttattcagttgcctgtccctttgacaagagacgaagtaaatcccgctatctcagatacataaaaataatgtatctatttttaggtatttttacttagaaatataattttaaatatttaatagagaatagtatgttttatttatctaagacatttcatactttattagtataaactcctttattttgaaaaaatattataaatattatctaggaagcacatagataatcattttctgcattttgggtagtaggtaaaatgaaattccaatcatcaatttaggaggctttggtggtgggactatgtattatgtcacttacagatctccatgaagagagaattttccattctgatgcctaattttgtagtcatngggctcagaggctttcatttacatgattaggtattgtcttgccaataaggtcaaaagtttctgccctatgttcagaaaaatataatcttgttaggtttattttgtatctacatctgtgctgtgcccatctccaaagacagatttaagcaaagatgtatacaatgcttcataatgagatcattatagcttttagtgcttttgtcatctctacaattatcaggtgatatattttgtatactattcatgtgttgttttgtttgaacatatttttattgcactgtcttttcttcgataaatctttaaaatatgtcattacctgtgctgtttgtgactattctaagtgctgtcatctgttatgttcatactttgtgtttgcacgatttaacttgatcatgattcattcttttttccccatgaatttttccccttacattgtctccatattttctatatctctctccttttctcccgctcttgtgcagatagctcctccaagaagacaaagtctagttcagaggagagtagatccgagatatatggtaagctaatgtagctaattcagccttgccctttggagcttgcttcatggtgttccttttctgttctttttttcctttctttctttctttttaaataactgcagcctttcttgtgtctgctgtgcatggcatgatctactgcagggaaagggagcctggggttttaacgtggctgtgatgtggaagcttaaggttgctagaaactaacattgtagattaagagtaggccacattgcccatcttctcccgtcttgtttatggtaggaaggtgattatctctaatatgtttgggtcaggttcctccaaataacatgaatgggctttgaattcttgtcatcttcttcccacatctcatttgcagagtttggattatgaagaatttgaggaattaagtcttttcctctaagtataatactggtgtaatttagacgtattagcagttctttggaatttttatttcattttttgtttgtttatttttaattgcctcgtcatgtggaaaagtcattcttgtataatttatccacgatggcaaaaatacgtaagtattttatcttcatagcttgaagaatttgtgcctttgagaagtttctctgaagcttaatcggaatgggaaaatttcagaatggtaccttttaaataatcttaacaaagagcaagtttaacctgagtggtcaacttttgcagcagatgattgaaatgctaatatttctagactgtgtcctgtcttccaaagatacaataaccatgtttgtgaagttcatacctatttttccttttcctttgcagttttatttgccctctttccttcttttggagtctgattagggttttgttttggggtttttttttttggttttttgttttttgagaaaagtgaataagagaggaattacctggagctaagattttaaaaataatttctgaaagactgataaattatttctttttttaggaagattccaaatttggcctcgaagggaaatcaggtcatctttaatagagccacaaatctatagagcagaagctcccccaggtgcagatagatgtttcctagcttgatatataggagaggaaaaaatacaggaattgccctcccctttttaagacatttgataattcacatctgctggcacttgagcccatatcagatactttttagtattatgaaagctcagtgtttggttctaaaccagttaattcttctatgttagatatatacacatagttctttacttgggtttttgtgaccagtgctttttctgtgtataccttttacagtagttcagcagtaaatgtatactgtgccttgtgacacatcaagtttacgctttttcttccttccagagtattttggctactgataagtaagaactacctaattcctggagactatatttctgttctatataaagagctttctatagtttatcctctccttaggaacatgaacattatctttatagctctattctttttcggtagcctttgcagtgttctatttcgtcttcctctccattttcctagatctgcgatgtgtatttagaagcttgttgtatgctttggatgaagactaacaatttaggaacctctgactagaaatactatactaatatttttcttagcagtgatagaaacattaatactagttcaggcatgccattggcttggtagtgatagaaacatnttaagtggtaattgggaagtaaggtgtggcttctctgtgtgtttgttttttgagaacccttgaaataccttttttggaaggaactgagtccacaagtcctcaaaaagcactcatcggagggatgagttgattagaacagaattagcatgctaacgtaaatctctttgacattacaaatattttatcacctgtgtgaatagacgtctttagattacgtacagttagcatagatgaaaaagtctctctggggattcagaaaagcttgaaactactgngtagaatcatagcaactggtgacattctgctttagtgtagggtcttattataagcccacttcaaactttagagattatacattgctttctcggggtaaaattcattagctgagtacttaacaaaaatgctagttactcacatattatttattttaaactttcttggcttttttttttttttttttttttttgagacaagatctcgctgtgtggcccaggatggagtataatggcgggatcatgactcactgcagcctcaacctcctgggctcaagtgatcctcctacctaagactccaaagtagctgggactacaggtgcacaccactgcacccagctgttttgtttgtttgtttgttttttaatagagatgaggttgttgaaggaatgatttgccagggg

SEQ ID NO: 439386 - DNA, 1799 bp, Homo sapiens
  misc_feature (3)..(3): n is a, c, g, or t
gcngccttttaaatgcttgatctgtatgaaattagtttttcattagaggaatatcttgcataaaactgtaatattacatgacagcaattggcaggagactaagggacactaattattataaaatttaattttattgtgttctgtagtttgtttcagacagggtcttgctctgttgcccaggctggaatgcagtggtgcagtcttggctcactgaagccttggcctcctggactcaggcagtccacccacctcagcctccctagcagctaggactataggtatatgccaccatacccagctaattctgtgttttgtaaagacaaggtctcgctgtgttgtcaggttggtccagatttcctgggctcaagtgctcctttctcagcctcccacagtgcagggattacaggcatgagccactatgcccagcctgtgttctgtagtttaaataagggtaggactgtttggtaactttccagatcatttaataacacaagatagcatactattttctcatgaggctcttcagaagcataaaagttggaaccattacaggaacgatagtaaaatgtttactaattgccacttctagtatgtgggcttatgtgttaactttttcggattttaagtgtttttgtaccatttcactaggtggtggttttggcagatttatttggtggctgttaaaatagacttttatgtcatatattaatacttcgtcaacaagcacgtaaatgtgcttattccccttagcttccaaagaatgagagttttctagagctgctaatactaaaagatgattctcttactaataagttgttaatatttagaccaagtctgagtagtacctggacttttcatgagtactatttcttagaactttctttgaaattagagccttggaactcagaagccactttcttatagacaagcatatgtaccatgctcatccagttattcataggaaaattaaaggatacgttgagaatctagtgactgaatgtttgtaacttgatcttcataatctgttatcatctgtttagagtgaggtttgaagatagtactcctgaatgttcttctgcaagataccttttcctttttagaaaattgtatgcagattactttaatatggcttttgtgccattttcaagaactgacaaatagcaataatgatagttgaatgtaaatggtgtattttatattaagaatttctttaaaagagactgtattatatagataatcatgttactgagtgcttggaaattatttgtgcatgattttctttattttgccagaatttggatttaacaaaaaggaagatgattcatgaagggccattggtttggaaggtgaatagagataaaactattggtaggtctgatattgtcttttagttttggggagagtggcaaaagggaaggaataggaaagtttcctatgacaaagggaagaggagagaaccattctctcagcagtttgcagtgctacctcgtgttatttgtacatttgtagatctgcttgtgttatttcattatatgtaagatgtgttaaatattcatttaggaatgtagtggagaactgatttagtcctatttccatcattcttatagtctagtgagtctttgtatgctttgtaagctttctttagaccagtacatcttaaactgtctgtgatgaggaaccgtttttgttttttcagaaacaaggtctttctatgttgcccaggctggagcacagtggctagtcacagatgcagtcatggtgcactgctgcctcgaactcctgggcttaagggatcctcc

SEQ ID NO: 439387 - DNA, 1116 bp, Homo sapiens
  misc_feature (1)..(2): n is a, c, g, or t
  misc_feature (216)..(216): n is a, c, g, or t
  misc_feature (487)..(487): n is a, c, g, or t
  misc_feature (555)..(555): n is a, c, g, or t
  misc_feature (1041)..(1041): n is a, c, g, or t
  misc_feature (1107)..(1107): n is a, c, g, or t
nnggttgttgtttgttttttatctttttcttttctaggaggaaaacaatgtggttcataaccagaaagtagaaattctgagaaaaatgttacagaaagaacaggaacggctacaggtattaaatgagaagtagggctgtttacaggccaataaaaatgtgagtgggcatggttgagttggtgtttatcagtcacaatcaagcagcattgtaaccantgccattagttatattattgattaagaatggactatttctgtatcttttttacataagtaattaattctgaaaatatttttataacttttcagttattgcaggaagattacaaccgaacacctgcccaaagattgctaaaagagatccaagaggccaagaaacacattcctcagctgcaagagcagttatccaaagccacaggctctgctcaggtagcatcactattacaagtgctacccaactttttgcaggagaattttcttctgggantgtgtcagagaatgttgcagttgccttttttaaagttatttttctagcgtaggacaacaggatgtccngttaaggatgttacagaagtaatgattaacaaaaataaatgtgggcgtctgattgtttgcttgctcatgagatcacatttctttgttccataataatttaaaaaagaattgagtgcttttgctttgatgtgacaaactactaaaatgtatttagatatatatatatatttatattttttgtggttcattctgccatcttaaaacagaatggcagttgatatgtttttaaataggaatttaagaatttacaacaacaggcattgagctaaatatatggacaagcattttcttatttaatctgcataacatctctgaggttacttatggttgttttcctccagtttacatatatacttagagagagttagagagattaaatgacttgtctgaggtcatatagctgcaaagtaatagaactggaattcaaacccagtctgaggatttaaaagcacattcatactcttaatgactatatttttattgtantttaaaaatagatttcagtagaatttgctgtatagttataagctatagagataatggtctcataanaaaaaaaaa

SEQ ID NO: 439388 - DNA, 7398 bp, Homo sapiens
  misc_feature (2)..(3): n is a, c, g, or t
tnnttttttttggtgaccagtgactttattaagtattaacactcttcaaatgtctgacttttgtctacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaacca

SEQ ID NO: 439389 - DNA, 11243 bp, Homo sapiens
  misc_feature (587)..(587): n is a, c, g, or t
  misc_feature (1519)..(1519): n is a, c, g, or t
aggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtaaaacactattcattctttcaaagagtattgagagtagtgaagttcagaataatagagcttaagctacccgaaacactcaggaatagttgtttgatctgttttaggactctcacattcctccaattatatcataataaagcctttgcatttagnaggaatgcaagcatttttaacttccaacactgtacattccactacagaagtatcattgtagagtatattgtatctttaaatagtgataataatagaaatggttatataataattggagatttggtcagatcaagaactcagtgttaagttgaatcatggtataagcagtaatatgtcataaaaccaaggctctaacaactcgacacttgcgtagtcatctaaaaattcaattgtgattatggtgaattggagttttagataaatcagtttcacaaattaatgatggtctcattttagagtaaacaaatgaatagaaatccctttctcttcagtcaaaaagtattctgaacttaaagagctgtctttcaacctaagcagtgtcgatctttcctagggttgtcaccttaacagactttcagattgatctccttttaaaacatctaggctttttccttttgctttctccttgtaagcttactccatatttgattcatagaaagtgcttggtaatcttgcttttttcatttgaaactgatatatattttttgtgcacatactattttattcagttgcctgtccctttgacaagagacgaagtaaatcccgctatctcagatacataaaaataatgtatctatttttaggtatttttacttagaaatataattttaaatatttaatagagaatagtatgttttatttatctaagacatttcatactttattagtataaactcctttattttgaaaaaatattataaatattatctaggaagcacatagataatcattttctgcattttgggtagtaggtaaaatgaaattccaatcatcaatttaggaggctttggtggtgggactatgtattatgtcacttacagatctccatgaagagagaattttccattctgatgcctaattttgtagtcatngggctcagaggctttcatttacatgattaggtattgtcttgccaataaggtcaaaagtttctgccctatgttcagaaaaatataatcttgttaggtttattttgtatctacatctgtgctgtgcccatctccaaagacagatttaagcaaagatgtatacaatgcttcataatgagatcattatagcttttagtgcttttgtcatctctacaattatcaggtgatatattttgtatactattcatgtgttgttttgtttgaacatatttttattgcactgtcttttcttcgataaatctttaaaatatgtcattacctgtgctgtttgtgactattctaagtgctgtcatctgttatgttcatactttgtgtttgcacgatttaacttgatcatgattcattcttttttccccatgaatttttccccttacattgtctccatattttctatatctctctccttttctcccgctcttgtgcagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaacca

SEQ ID NO: 439390 - DNA, 9316 bp, Homo sapiens
aatagatggttgattttaacactcctctaaataaagaaaatatataatatattcttggagttataaattttatttgcttttaagtaatatctgatcttactagtagtaacttgctatctgaaaacggcatcattcttttggatttttagggcagtcataaaagagaaatgacaaattagtttttttttctgtggagacatgatgtagcagatgatgggactgtcttacataactggatcttttagaactatcgaagattaagtagtaaaatggtataaaaagtttcttgacaatgttattttcccttcccttccctttttccgtctccccaccccaagctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaacca

SEQ ID NO: 439391 - DNA, 9616 bp, Homo sapiens
aggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaacca

SEQ ID NO: 439392 - DNA, 9324 bp, Homo sapiens
  misc_feature (37)..(38): n is a, c, g, or t
tgtgtggtaatcgcagttagtaatcaaagagtaaaannagcctggcacgcctgcgcagtttattactaatatataattattgtcttttcctttctctgttttctcttccttcttgttttacactgtggttcttgtgcaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaacca

SEQ ID NO: 439393 - DNA, 7343 bp, Homo sapiens
  misc_feature (2)..(3): n is a, c, g, or t
tnnttttttttggtgaccagtgactttattaagtattaacactcttcaaatgtctgacttttgtctacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgacctgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaacca

SEQ ID NO: 439394 - DNA, 6755 bp, Homo sapiens
  misc_feature (2)..(3): n is a, c, g, or t
tnnttttttttggtgaccagtgactttattaagtattaacactcttcaaatgtctgacttttgtctacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagaagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaacca

SEQ ID NO: 439395 - DNA, 1840 bp, Homo sapiens
ggaaaaatactttgaccatagctctagtacttccagtgtcttgtccttagaaattgaactgcagggaaagcaaataattactaaggacaagacactggctgaactagactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaacca

SEQ ID NO: 439396 - DNA, 2268 bp, Homo sapiens
  misc_feature (2)..(3): n is a, c, g, or t
tnnttttttttggtgaccagtgactttattaagtattaacactcttcaaatgtctgacttttgtctacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtgtatgtatcagatatggctaccttgctatagctaatattttcattatcccaagcgtaatattccataaacttaactttgtttttataatgtatgga

SEQ ID NO: 439397 - DNA, 320 bp, Homo sapiens
ggctacctcaggaaacttctctattcccttcaggcagaaacgtagtatgggactgaccttggctgaaagcgagctgactaaacttgatgcagagcgagacaaggaccgattgactttggagaaggagcggacatgtgcagaacagattgttgccaaaattgaagaagtattgtaagtaatagaagtatatgtggaaatgccctctctgctgagatactagttatgcttgaagtgtcctttgggtaggtttagaaaaactgtcagattgtgtatgtggagccgtttattttgtcatagtacttgagaaactggattttttt

SEQ ID NO: 439398 - DNA, 812 bp, Homo sapiens
tcctgtaatcccagcactttgggaggccgagcgggcggattacgtaaggccaagagttcgagaccaagctggccaacatggtgaaaccccatctctactaaaaaccccaaaattagccaggcatggtggcactcctgtaatcccagctactcagaaggctgaggcacgagaatcacttgcgcccaggaggcggaggttgcagtgagccaggatcatgccattgcactccagcctgggtggcagagtgagactctgtctcaaaaaaattaattaaacttccatatttcatttttaaatttttttttcttttttttaaggatgactgctcaggctgtagaggaagataagaggtaacataactgttttttttcccctagaattttaagaaaaaaagaactatgtttttttcctttcagtcctaaattacaatttatttcttttaacttacaaatacagtttgtggtctctctctggtggcttgtatgttatttgactaatattctactgttgtcctgagtagaattctcttctctgtgcaatgactagttagttctttagtgtttgtttgatttatttcaataattccaaccttggggttttggaaatcatttgatgtctttattctaccaaccctcccttctcagaagtcttaatttacttcgtcctttctcctccagctccaccatgcagtatgttattctcatgtatatgaagcatttgggagtaaaagtgaaagagcctcgaaatttggagcacaaacggggtcggattggatttcttcccaaaatcaaggtaagaatgaaataatgtaa

SEQ ID NO: 439399 - DNA, 336 bp, Homo sapiens
ggtctggttgtgtcaagatcagacctttttaatggagaaccattgatattccacatagatatgcagttctgtgtattttgtcacttgaaatattgaaaggattctggttgtctgtcactttgtctggcttgtataagctcagtttcccattctcttttgtgttctttgcattcttggcacagttcagcggaccaggagaggagaaattgaaacatgctgctgctaccttttgcagtaaccaacctttcgccctggaaatgatcaaatctcgtcagaaaaaggattctcgatttcagacttttgtgcaatttgtgcaagtgagttgagtgagtcatg

SEQ ID NO: 439400 - DNA, 6530 bp, Homo sapiens
ttttttcccacagcaactgccaatgaaggatgaatcccctttttaaaaagttgttgttgttgttgtgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaacca

SEQ ID NO: 439401 - DNA, 6850 bp, Homo sapiens
  misc_feature (3)..(3): n is a, c, g, or t
gcngccttttaaatgcttgatctgtatgaaattagtttttcattagaggaatatcttgcataaaactgtaatattacatgacagcaattggcaggagactaagggacactaattattataaaatttaattttattgtgttctgtagtttgtttcagacagggtcttgctctgttgcccaggctggaatgcagtggtgcagtcttggctcactgaagccttggcctcctggactcaggcagtccacccacctcagcctccctagcagctaggactataggtatatgccaccatacccagctaattctgtgttttgtaaagacaaggtctcgctgtgttgtcaggttggtccagatttcctgggctcaagtgctcctttctcagcctcccacagtgcagggattacaggcatgagccactatgcccagcctgtgttctgtagtttaaataagggtaggactgtttggtaactttccagatcatttaataacacaagatagcatactattttctcatgaggctcttcagaagcataaaagttggaaccattacaggaacgatagtaaaatgtttactaattgccacttctagtatgtgggcttatgtgttaactttttcggattttaagtgtttttgtaccatttcactaggtggtggttttggcagatttatttggtggctgttaaaatagacttttatgtcatatattaatacttcgtcaacaagcacgtaaatgtgcttattccccttagcttccaaagaatgagagttttctagagctgctaatactaaaagatgattctcttactaataagttgttaatatttagaccaagtctgagtagtacctggacttttcatgagtactatttcttagaactttctttgaaattagagccttggaactcagaagccactttcttatagacaagcatatgtaccatgctcatccagttattcataggaaaattaaaggatacgttgagaatctagtgactgaatgtttgtaacttgatcttcataatctgttatcatctgtttagagtgaggtttgaagatagtactcctgaatgttcttctgcaagataccttttcctttttagaaaattgtatgcagattactttaatatggcttttgtgccattttcaagaactgacaaatagcaataatgatagttgaatgtaaatggtgtattttatattaagaatttctttaaaagagactgtattatatagataatcatgttactgagtgcttggaaattatttgtgcatgattttctttattttgccagaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaacca

SEQ ID NO: 439402 - DNA, 576 bp, Homo sapiens
cttggaacccatgaggctagttttacctctgtgagtttctgagttgtaatagagatacaatattatgcaatgatattctaaattattatttgacttgaaacttctgaactactcagctttgaattatttgatttctgtgaatctgatcttcagatttatggtataagctttatatctgccatgtaagcttctttaaaacatgccaaggtagagatgtagttgtgttctatttgtctttaaaaataaatatcaatatattttctattttagggcatttgatgtagaactactgtacatagcacagttctttaaaattccaatagcagaaattgctgtcaactggacagaaattgaaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtc

SEQ ID NO: 439403 - DNA, 675 bp, Homo sapiens
cttggaacccatgaggctagttttacctctgtgagtttctgagttgtaatagagatacaatattatgcaatgatattctaaattattatttgacttgaaacttctgaactactcagctttgaattatttgatttctgtgaatctgatcttcagatttatggtataagctttatatctgccatgtaagcttctttaaaacatgccaaggtagagatgtagttgtgttctatttgtctttaaaaataaatatcaatatattttctattttagggcatttgatgtagaactactgtacatagcacagttctttaaaattccaatagcagaaattgctgtcaactggacagaaattgaaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtcagccttttgataattttaaagaaataactttccataagtaaaaaattatatatctctttggatataaatgatttttaaaagatgtttatttaaaaagtc

SEQ ID NO: 439404 - DNA, 352 bp, Homo sapiens
acattctcattttataaatacattatggggggggggggccttcttgggctacagatgtcagactcttgtacatagcacagttctttaaaattccaatagcagaaattgctgtcaactggacagaaattgaaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtc

SEQ ID NO: 439405 - DNA, 627 bp, Homo sapiens
  misc_feature (457)..(458): n is a, c, g, or t
  misc_feature (525)..(525): n is a, c, g, or t
gcgcttccgcctgtgtggaggtgcgggattgggcgggctgccacggcatggagaatggctccgcttctgttgcagctggcggtgctcggcgcggcgctggcggccgcagccctcgtactgaaacgagatcctgcgttcacttatgaagtgatagtagttgatgatggcagtaaagatcagacctcaaaggtagcttttaaatattgccagaaatatggaagtgacaaagtacgtgtgataaccctggtgaagaatcgtggaaaaggtggagcgattagaatgggtatattcagttctcgaggagaaaagatccttatggcagatgctgatggagccacaaagtttccagatgttgagaaattagaaaaggggctaaatgatctacagccttggcctaatcaaatggctatagcatgtggatctcgagctcatttagaaaaagaatcaattgctcagnnagcgttcttaacttcggtaccctcttctcaatggtatgggggttcccaccttttctgggtggtggtntcccctttggtggttcaaagggatatcagggggaccacaccagtgggtgggtttccaaattatttttacttcggaagaaagcagctttcaccggaccgtttt

SEQ ID NO: 439406 - DNA, 1098 bp, Homo sapiens
gcgcttccgcctgtgtggaggtgcgggattgggcgggctgccacggcatggagaatggctccgcttctgttgcagctggcggtgctcggcgcggcgctggcggccgcagccctcgtactgatttccatcgttgcatttacaactgctacaaaaatgccagcactccatcgacatgaagaagagaaattcttcttaaatgccaaaggccagaaagaaactttacccagcatatgggactcacctaccaaacaactttctgtcgttgtgccttcatacaatgaagaaaaacggttgcctgtgatgatggatgaagctctgagctatctagagaagagacagaaacgagatcctgcgttcacttatgaagtgatagtagttgatgatggcagtaaagatcagacctcaaaggtagcttttaaatattgccagaaatatggaagtgacaaagtacgtgtgataaccctggtgaagaatcgtggaaaaggtggagcgattagaatgggtatattcagttctcgaggagaaaagatccttatggcagatgctgatggagccacaaagtttccagatgttgagaaattagaaaaggggctaaatgatctacagccttggcctaatcaaatggctatagcatgtggatctcgagctcatttagaaaaagaatcaattgctcagccactttctggtgtggttcctttgtgtcaaaggaatcagggacacacagtgtgggttcaaattatttactcgagaagcagcttcacggacgttttcatctctacacgttgaacgatgggcatttgatgtagaactactgtacatagcacagttctttaaaattccaatagcagaaattgctgtcaactggacagaaattgaaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtc

SEQ ID NO: 439407 - DNA, 1297 bp, Homo sapiens
cgccattctcctgcctcagcctcccgagtagctggaactacagacgcccgccaccgcgccccgctaattttttgtatttttagtacagacggggtttcaccgtgttagccaggatggtctcgatctcctgaccttgtgatccgcccgcctcgtcctcccaaagtgctgggattacaggcgtgagccacggcgctcggccgagaaacctgaactttctgtgcgctcattgtccgcaccacgttctgctctgcaggtcccggagctgagggctcctaagcatcaccttgtgttgtagactgtgtcgtgctcaaggctgccatctccctcctagatttccatcgttgcatttacaactgctacaaaaatgccagcactccatcgacatgaagaagagaaattcttcttaaatgccaaaggccagaaagaaactttacccagcatatgggactcacctaccaaacaactttctgtcgttgtgccttcatacaatgaagaaaaacggtaaacgagatcctgcgttcacttatgaagtgatagtagttgatgatggcagtaaagatcagacctcaaaggtagcttttaaatattgccagaaatatggaagtgacaaagtacgtgtgataaccctggtgaagaatcgtggaaaaggtggagcgattagaatgggtatattcagttctcgaggagaaaagatccttatggcagatgctgatggagccacaaagtttccagatgttgagaaattagaaaaggggctaaatgatctacagccttggcctaatcaaatggctatagcatgtggatctcgagctcatttagaaaaagaatcaattgctcagcgttcttacttccgtactcttctcatgtatgggttccactttctggtgtggttcctttgtgtcaaaggaatcagggacacacagtgtgggttcaaattatttactcgagaagcagcttcacggacgttttcatctctacacgttgaacgatgggcatttgatgtagaactactgtacatagcacagttctttaaaattccaatagcagaaattgctgtcaactggacagaaattgaaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtc

SEQ ID NO: 439408 - DNA, 981 bp, Homo sapiens
gcgcttccgcctgtgtggaggtgcgggattgggcgggctgccacggcatggagaatggctccgcttctgttgcagctggcggtgctcggcgcggcgctggcggccgcagccctcgtactgatttccatcgttgcatttacaactgctacaaaaatgccagcactccatcgacatgaagaagagaaattcttcttaaatgccaaaggccagaaagaaactttacccagcatatgggactcacctaccaaacaactttctgtcgttgtgccttcatacaatgaagaaaaacggttgcctgtgatgatggatgaagctctgagctatctagagaagagacagaaacgagatcctgcgttcacttatgaagtgatagtagttgatgatggcagtaaagatcagacctcaaaggtagcttttaaatattgccagaaatatggaagtgacaaagtacgtgtgataaccctggtgaagaatcgtggaaaaggtggagcgattagaatgggtatattcagttctcgaggagaaaagatccttatggcagatgctgatggagccacaaagtttccagatgttgagaaattagaaaaggggctaaatgatctacagccttggcctaatcaaatggctatagcatgtggatctcgagctcatttagaaaaagaatcaattgctcagggcatttgatgtagaactactgtacatagcacagttctttaaaattccaatagcagaaattgctgtcaactggacagaaattgaaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtc

SEQ ID NO: 439409 - DNA, 921 bp, Homo sapiens
gcgcttccgcctgtgtggaggtgcgggattgggcgggctgccacggcatggagaatggctccgcttctgttgcagctggcggtgctcggcgcggcgctggcggccgcagccctcgtactgatttccatcgttgcatttacaactgctacaaaaatgccagcactccatcgacatgaagaagagaaattcttcttaaatgccaaaggccagaaagaaactttacccagcatatgggactcacctaccaaacaactttctgtcgttgtgccttcatacaatgaagaaaaacggttgcctgtgatgatggatgaagctctgagctatctagagaagagacagaaacgagatcctgcgttcacttatgaagtgatagtagttgatgatggcagtaaagatcagacctcaaaggtagcttttaaatattgccagaaatatggaagtgacaaagtacgtgtgataaccctggtgaagaatcgtggaaaaggtggagcgattagaatgggtatattcagttctcgaggagaaaagatccttatggcagatgctgatggagccacaaagtttccagatgttgagaaattagaaaaggggctaaatgatctacagccttggcctggcatttgatgtagaactactgtacatagcacagttctttaaaattccaatagcagaaattgctgtcaactggacagaaattgaaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtc

SEQ ID NO: 439410 - DNA, 1133 bp, Homo sapiens
gcgcttccgcctgtgtggaggtgcgggattgggcgggctgccacggcatggagaatggctccgcttctgttgcagctggcggtgctcggcgcggcgctggcggccgcagccctcgtactgatttccatcgttgcatttacaactgctacaaaaatgccagcactccatcgacatgaagaagagaaattcttcttaaatgccaaaggccagaaagaaactttacccagcatatgggactcacctaccaaacaactttctgtcgttgtgccttcatacaatgaagaaaaacggttgcctgtgatgatggatgaagctctgagctatctagagaagagacagaaacgagatcctgcgttcacttatgaagtgatagtagttgatgatggcagtaaagatcagacctcaaaggtagcttttaaatattgccagaaatatggaagtgacaaagtacgtgtgataaccctggtgaagaatcgtggaaaaggtggagcgattagaatgggtatattcagttctcgaggagaaaagatccttatggcagatgctgatggagccacaaagtttccagatgttgagaaattagaaaaggggctaaatgatctacagccttggcctaatcaaatggctatagcatgtggatctcgagctcatttagaaaaagaatcaattgctcagcgttcttacttccgtactcttctcatgtatgggttccactttctggtgtggttcctttgtgtcaaaggaatcagggacacacagtgtgggttcaaattatttactcgagaagcagcttcacggacgttttcatctctacacgttgaacgatgggcatttgatgtagaactactgtacatagcacagttctttaaaattccaatagcagaaattgctgtcaactggacagaaattgaaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtc

SEQ ID NO: 439411 - DNA, 1232 bp, Homo sapiens
gcgcttccgcctgtgtggaggtgcgggattgggcgggctgccacggcatggagaatggctccgcttctgttgcagctggcggtgctcggcgcggcgctggcggccgcagccctcgtactgatttccatcgttgcatttacaactgctacaaaaatgccagcactccatcgacatgaagaagagaaattcttcttaaatgccaaaggccagaaagaaactttacccagcatatgggactcacctaccaaacaactttctgtcgttgtgccttcatacaatgaagaaaaacggttgcctgtgatgatggatgaagctctgagctatctagagaagagacagaaacgagatcctgcgttcacttatgaagtgatagtagttgatgatggcagtaaagatcagacctcaaaggtagcttttaaatattgccagaaatatggaagtgacaaagtacgtgtgataaccctggtgaagaatcgtggaaaaggtggagcgattagaatgggtatattcagttctcgaggagaaaagatccttatggcagatgctgatggagccacaaagtttccagatgttgagaaattagaaaaggggctaaatgatctacagccttggcctaatcaaatggctatagcatgtggatctcgagctcatttagaaaaagaatcaattgctcagcgttcttacttccgtactcttctcatgtatgggttccactttctggtgtggttcctttgtgtcaaaggaatcagggacacacagtgtgggttcaaattatttactcgagaagcagcttcacggacgttttcatctctacacgttgaacgatgggcatttgatgtagaactactgtacatagcacagttctttaaaattccaatagcagaaattgctgtcaactggacagaaattgaaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtcagccttttgataattttaaagaaataactttccataagtaaaaaattatatatctctttggatataaatgatttttaaaagatgtttatttaaaaagtc

SEQ ID NO: 439412 - DNA, 779 bp, Homo sapiens
cgctttagaaaattattagttgtgatgctggcagtaaacgatcagacctcaaaggtagcttttaaatattgccagaaatatggaagtgacaaagtacgtgtgataaccctggtgaagaatcgtggaaaaggtggagcgattagaatgggtatattcagttctcgaggagaaaagatccttatggcagatgctgatggagccacaaagtttccagatgttgagaaattagaaaaggggctaaatgatctacagccttggcctaatcaaatggctatagcatgtggatctcgagctcatttagaaaaagaatcaattgctcagcgttcttacttccgtactcttctcatgtatgggttccactttctggtgtggttcctttgtgtcaaaggaatcagggacacacagtgtgggttcaaattatttactcgagaagcagcttcacggacgttttcatctctacacgttgaacgatgggcatttgatgtagaactactgtacatagcacagttctttaaaattccaatagcagaaattgctgtcaactggacagaaattgaaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtc

SEQ ID NO: 439413 - DNA, 1019 bp, Homo sapiens
gcgcttccgcctgtgtggaggtgcgggattgggcgggctgccacggcatggagaatggctccgcttctgttgcagctggcggtgctcggcgcggcgctggcggccgcagccctcgtactgatttccatcgttgcatttacaactgctacaaaaatgccagcactccatcgacatgaagaagagaaattcttcttaaatgccaaaggccagaaagaaactttacccagcatatgggactcacctaccaaacaactttctgtcgttgtgccttcatacaatgaagaaaaacggttgcctgtgatgatggatgaagctctgagctatctagagaagagacagaaacgagatcctgcgttcacttatgaagtgatagtagttgatgatggcagtaaagatcagacctcaaaggtagcttttaaatattgccagaaatatggaagtgacaaagtacgtgtgataaccctggtgaagaatcgtggaaaaggtggagcgattagaatgaatcaaatggctatagcatgtggatctcgagctcatttagaaaaagaatcaattgctcagcgttcttacttccgtactcttctcatgtatgggttccactttctggtgtggttcctttgtgtcaaaggaatcagggacacacagtgtgggttcaaattatttactcgagaagcagcttcacggacgttttcatctctacacgttgaacgatgggcatttgatgtagaactactgtacatagcacagttctttaaaattccaatagcagaaattgctgtcaactggacagaaattgaaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtc

SEQ ID NO: 439414 - DNA, 574 bp, Homo sapiens
  misc_feature (454)..(454): n is a, c, g, or t
  misc_feature (456)..(457): n is a, c, g, or t
  misc_feature (538)..(538): n is a, c, g, or t
  misc_feature (574)..(574): n is a, c, g, or t
gcgcttccgcctgtgtggaggtgcgggattgggcgggctgccacggcatggagaatggctccgcttctgttgcagctggcggtgctcggcgcggcgctggcggccgcagccctcgtactgatttccatcgttgcatttacaactgctacaaaaatgccagcactccatcgacatgaagaagagaaattcttcttaaatgccaaaggccagaaagaaactttacccagcatatgggactcacctaccaaacaactttctgtcgttgtgccttcatacaatgaagaaaaacggttgcctgtgatgatggatgaagctctgagctatgctagatgaagggagggggaatccaagggtaaagaacaacgcccggggaggggggaaaatttaaagccaacttttggggggcaacccggggctttgtgtttgcggggcccccaaagggggggccctcttngnnaataaaattgtttatctcattgtcatacacaggccttttcagtttcctgctaacagattcaggttagataaggattacagnaagtgatactcccaagttcctctctataacagtcgn

SEQ ID NO: 439415 - DNA, 179 bp, Homo sapiens
tagttattgggctgtatttccacctatctccttctatcctgtcctgcatgaagaaagggacttcatgactgttctttgctgaatttgttatgttctaggcctgtcatgtcataacctttccagaattgttttttttctttggtttggttttggtattgagacagagtctcactgtcacc

SEQ ID NO: 439416 - DNA, 892 bp, Homo sapiens
gagtctctagagacaaggatctgattgcaggtggagaggggatgttgagacaggggcaggagactgcctgtgagagagggatgatctcaagaagagacctggcacaggaaaccaaaaggaggcaactgtagggaatgaaacttaagggtctgggaaagcgctgtaaaaggagagaggacctggagatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 439417 - DNA, 362 bp, Homo sapiens
tgtaatggttggggttagtgtcctactcatcatccagagtgtgatgctggtcgtccttttccctcagagcagtgacagcattagtgccccgcggacccaggattcaggcattgccccagggtgtggtagtcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 439418 - DNA, 912 bp, Homo sapiens
gactggctctgactcttcacccatcttcacccaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 439419 - DNA, 1186 bp, Homo sapiens
ggcccctgggcgcgcgccgcgaagggacaaccagcgaggcagtgggaagaggtcagagcgcgtgcgcacccgaggggcttactgccacagccgctgcctgaggctggagtgcagtggcacgatctcggctcactgcaacctccatctccagggttcaagtgcttctcctgcctcagcctcccaagtagctggtattacaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatggtaacgggggagcgctacgccggggactggcggagggggggcccacgcgtaaatagccgaggctggatcgggcgctgacaagtcccttctctgccgcggatggtctggatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 439420 - DNA, 894 bp, Homo sapiens
ttttggtaaagcttccccagcaacgtcagctagagttgcaaatcactgctcaacagaacctcttacgaagcaaagacataaagaaaaataagccgggcagagtgggtcatgcctgtaatcccagcactttgggaggctgaggcaggcggatcacataaggtcaggagttcgagaccagcctggccaacgtggtgagaccccgtctctactaaaaatacaaaaataagccaggtacgtggggtaggaggtcgtggggtaggaggtcctcctaccccacatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 439421 - DNA, 1374 bp, Homo sapiens
ggcccctgggcgcgcgccgcgaagggacaaccagcgaggcagtgggaagaggtcagagcgcgtgcgcacccgaggggcttactgccacagccgctgcctgaggctggagtgcagtggcacgatctcggctcactgcaacctccatctccagggttcaagtgcttctcctgcctcagcctcccaagtagctggtattacaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcccaaaaaaaaaaaaaaaatgggctcttggccaacgggtggagccttggggccgttcctttagtgagggtaattctgatcctcgtttcgtattccttgccgtcggacgtctgctgcggaaacggttttatctactcaaggcgggatgtcggtttcccgagagcaaggatacccgagaaagaattttgtgcaaaggcgcacgaatgcgggaacctagcagccggggtgtagggtgttcttagtgtccgaccctgctagtttcaaatttcactcgtagtataggtcgtaactcccaggtt

SEQ ID NO: 439422 - DNA, 928 bp, Homo sapiens
ggcccctgggcgcgcgccgcgaagggacaaccagcgaggcagtgggaagaggtcagagcgcgtgcgcacccgaggggcttactgccacagccgctgcctgaggctggagtgcagtggcacgatctcggctcactgcaacctccatctccagggttcaagtgcttctcctgcctcagcctcccaagtagctggtattacaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatgttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 439423 - DNA, 798 bp, Homo sapiens
gactggctctgactcttcacccatcttcacccaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 439424 - DNA, 300 bp, Homo sapiens
gtctccttgcctctctccctgtcactgtctctctctctcccctgcctcccccttggtctctttttttgctgtctctttctgatgaccttgttcccatctctgtgcgtgtgtggctctctccctgcccatctcttaccatctctgccttcctctcccaggtcttaaacgaatatttccacaatgtctgtgaactggacctggtgttcaacttctacaaggtaggctcctggtgaagaggaggctgaaggagccagaggagggggacgggggggacccgtggtgcactagccacccggagcc

SEQ ID NO: 439425 - DNA, 1078 bp, Homo sapiens
ggcccctgggcgcgcgccgcgaagggacaaccagcgaggcagtgggaagaggtcagagcgcgtgcgcacccgaggggcttactgccacagccgctgcctgaggctggagtgcagtggcacgatctcggctcactgcaacctccatctccagggttcaagtgcttctcctgcctcagcctcccaagtagctggtattacaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 439426 - DNA, 1168 bp, Homo sapiens
  misc_feature (1092)..(1096): n is a, c, g, or t
  misc_feature (1099)..(1128): n is a, c, g, or t
  misc_feature (1131)..(1132): n is a, c, g, or t
  misc_feature (1143)..(1143): n is a, c, g, or t
  misc_feature (1145)..(1145): n is a, c, g, or t
  misc_feature (1148)..(1148): n is a, c, g, or t
  misc_feature (1150)..(1150): n is a, c, g, or t
ggcccctgggcgcgcgccgcgaagggacaaccagcgaggcagtgggaagaggtcagagcgcgtgcgcacccgaggggcttactgccacagccgctgcctgaggctggagtgcagtggcacgatctcggctcactgcaacctccatctccagggttcaagtgcttctcctgcctcagcctcccaagtagctggtattacaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggccaaaaaaaaaagtannnnncannnnnnnnnnnnnnnnnnnnnnnnnnnnnnagnntgtaaaatttntnttntntttttttttttttttttt

SEQ ID NO: 439427 - DNA, 645 bp, Homo sapiens
acgccatgagacccgtacgacgaagcgtatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 439428 - DNA, 954 bp, Homo sapiens
gactggctctgactcttcacccatcttcacccaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggaggtcctggcaagctccgttgctgacagcctctctgttctgcagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 439429 - DNA, 640 bp, Homo sapiens
aaggagtgaatgttttggccccactctgtctggcacgttaggtcctggcaagctccgttgctgacagcctctctgttctgcagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 439430 - DNA, 840 bp, Homo sapiens
gactggctctgactcttcacccatcttcacccaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgtcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggcc

SEQ ID NO: 439431 - DNA, 1669 bp, Homo sapiens
agtgtgggcgcgtaataggaatcaccctcctactgcgcgttttcaaagaccaagcgctgggcgctcccgggccgcgcgtctgcgttaggcagggcagggtagtgcagggaaccttccccggggttcggggttcggggttcggttgcagggctgcagcgcccttggctttctccctcacccaagtttccggagagccgacctaaaagtaacaatagataaggtttcctgctccagtgtatctcaaaagaccgggcgccaggggggggggacctagggcgacgtcttcagagtccgccagtgttggcgttgttcgcgcaaacctgcaggctcccgagtggggcctgccttggtctctagagggttgctgcctttcaagcggtgcctaagaagttattttcttgtttaacatatatatttattaatttatttgtcgtgttggaaaatgtgtctctgctttccttttctctgcttgcctagccccaggtcttttctttgggaccctgggggcgggcatggaagtggaagtaggggcaagctcttgccccactccctggccatctcaacgcctctcctcaatgctgggccctcttatctcatcctttcctctagcttttctatttttgattgtgttgagtgaagtttggagatttttcatacttttcttactatagtctcttgtttgtcttattaggataatacataaatgataatgtgggttatcctcctctccatgcacagtggaaagtcctgaactcctggctttccaggagacatatataggggaacatcaccctatatataatttgagtgtatatatatttatatatatgatgtggacatatgtatacttatcttgctccattgtcatgagtccatgagtctaagtatagccactgatggtgacaggtgtgagtctggctggaacactttcagtttcaggagtgcaagcagcactcaaacctggagctgaggaatctaattcagacagagactttaatcactgctgaagatgcccctgctccctctgggttccagcagaggtgattcttacatatgatccagttaacatcatcactttttttgaggacattgaaagtgaaataatttgtgtctgtgtttaatattaccaactacattggaagcctgagcagggcgaggaccaataattttaattatttatatttcctgtattgctttagtatgctggcttgtacatagtaggcactaaatacatgtttgttggttgattgtttaagccagagtgtattacaacaatctggagatactaaatctggggttctcaggttcactcattgacatgatatacaatggttaaaatcactattgaaaaatacgttttgtgtatatttgcttcaacaactttgtgctttcctgaaagcagtaaccaagagttaagatatccctaatgttttgcttaaactaatgaacaaatatgctttgggtcataaatcagaaagtttagatctgtcccttaataaaaatatatattactactcctttggaaaatagatttttaatggttaagaactgtgaaatttacaaatcaaaatcttaatcattatccttctaagaggatacaaatttagtgctcttaacttgttaccattgtaatattaactaaataaacagatgtattatgctgttgcaa

SEQ ID NO: 439432 - DNA, 3946 bp, Homo sapiens
gttctccgcccccgccgccgccattacggagctcccagtggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439433 - DNA, 2427 bp, Homo sapiens
tcaaggggtcctccagcgtcagcctcccaaagtgctgggattgtaggtgtgagcctataatccgtcttccccaattttttttttttaatgagaagtcgtcaggcactgtttacatttttgcaaacatctttaacatctagcataacagaagacagctagtatctgttccagtttattttgggttacttatttgaagaaaatctaaccttacacagaaatacaattagaaaaggatggaatattttaagataactttgagatagttgtagaaattattctttgatactacaccaaaactcaacaaatcgttatttttttaacagctttattgaggttgatttgcataccttatacaatttaatttatataattacagtttataactcagtgattttcagtaactttatagaattgtacaactatcacagtccaattttcggacatttctgtcacccaaaaaagatcccttgtagccatttgcagtcactccctattccaccagcagcctcaggcaacctctagtctgttctgtctctctgcagatttgcattttgttcacatttcatatggatagaatctagaatcatgtactatatgatcttttgtgtctggcttcttttggcatgatgtttttgaattttatccacgttgcagcatgtaccagtgctttcattcttttttattgtccaatagtatttcattctatggatgtcacattttgtttatccattcatgagatgatgatggacatttggattatttctacttttcagctaattatgaataatactgcctatgaacatttatgttcaagtctgcgtggatatgtttttaggacttgctgggccatatggtaaatttatgttctaagaaactggcagtgtttataagggctcaagtcgtttgtgtgtttgagatggggtctcactctgtcacccaggctagagtgcagtggtgtgatcttggctcactgcaacctccacctccctggctcaagcaatcctcccatcttagcctccctaatagctgggattataggcgtgcaccaccaccatgcctgattaattttgtatttttgtagaaatggggtttcgccgtgttgcccaggctactcttgaactcctgggttcagtgaagtagtctgcctgcctcagcttcccaaagtgttggaattacaggtgtgatccaccacacctgaccagggctcgagtttctccatatcctcctcaacgtttgttactcttttttattatagccatactagtggatatagggtatctcgttgtagttttgattggcatttccctaataattactgatgttgagcatctcttgtgcttaaggccatttgtttattgtctgtagtgaaatgtttattcaaatcttttgcccatttttaaaagggggttggttattcgttaacaagaattcattactctagacataaagtctcatcagattttttctcctattctgtgactttctcagtagtatcttttgaagcgtttactttttgatgaagtcctatttatcatttttaaaaattgcttttgcagttttatggttatctaagaaacattgcctaattaaaggtaatgaaaatttactcgtacgtttaagagtttataattttggctcctacatttaggtctgtgatctatattgttttgtttatagtgagaggtaagggtataatttatctttttgcatgtgggtgtgtgattattccagcaccttttattgaaaagactgtcccttccctattgaattgccgtagcatcttatgaaaatcaattgaccataaatataagggtttatttccggattctgagttctcttttgttctgtaggtgtatccttcatgctaatactgcactgtcttactgactgtagctttatagtgaattttgaaatttggaattataagccctctaactttttcaggaatgttttgactatgccgggtcctgtacagttccatacaaattgtccatttctgccaaaaaaaaaaaaccaaaaaaacagctggagttttggtaggaattgccttgaacctatagatcaatttggggagactcactgtcaacaacgttgagttttccaatccatgacacagaggtctctttatttaatttctctcagcagtgttttgtagttgttcggtgtacgagtcttgaattttttttgttaaatttattgccaagtattttattctttttccatgctgtcttgaatggtggaagtgttttctaattttcgttttcaggttgttaacgctaacctgtagaaatacaatcgatttgtccattgctcttgtatccttcgcccttgctgaactcaccagttgtagtagtttctttgtgaattccttacagttttctacatacaggatctgttatctgcaaataaagagcattttacttcttt

SEQ ID NO: 439434 - DNA, 4366 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439435 - DNA, 3828 bp, Homo sapiens
agcggagagctcggcggctgggactggaggacagcggtggcggaggcgactagcggcggcgggagcggcgccgagaggccgtgcgggacgcgggcgccaggaccggccgaacgcagagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439436 - DNA, 3519 bp, Homo sapiens
ccaatccggcacccgacataaaccatatcggctaggtcgagcggtgttgatcggccgaggcagtgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439437 - DNA, 4285 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439438 - DNA, 3773 bp, Homo sapiens
agcggagagctcggcggctgggactggaggacagcggtggcggaggcgactagcggcggcgggagcggcgccgagaggccgtgcgggacgcgggcgccaggaccggccgaacgcagagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaaaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439439 - DNA, 3195 bp, Homo sapiens
cctccagcctcccaaagtgctggggctataggtgtgagcacccagccaaaagaatcttaatttttagggacataactggttaacctgcttattgggtacagttgtcagtatctttgggctaggttggctattattttagggtggatggagggtagatggaaggagaaaatatccataggagggttgggacttctcagttagattgaatacctgttgaatgggaagagaaagtccctaagctgacaatttattgtaaaacatatctgtgctaatgcaggaactccgacccacctggtgcagaggagtcttgtcttgacctgctttgggagagtgttgtcttgatgcttttctcttcctccttggaaaacagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439440 - DNA, 2755 bp, Homo sapiens
atttcgcgaattcaccatgaagaagtctttcagagtgaacaagtaaatttcataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439441 - DNA, 2699 bp, Homo sapiens
agcggagagctcggcggctgggactggaggacagcggtggcggaggcgactagcggcggcgggagcggcgccgagaggccgtgcgggacgcgggcgccaggaccggccgaacgcagagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439442 - DNA, 3838 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctccccctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439443 - DNA, 1059 bp, Homo sapiens
aaaattgggtttttatgttttaaactaaataattgacaccccccccacacgacacttctgccccggggtgggggggggggggaggtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439444 - DNA, 2797 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439445 - DNA, 1059 bp, Homo sapiens
ggaaaagccttcagtgtgtccacatccttaaaaaaacatatgagaatgcacaatcgatagaaactctataaatgtgagaaataggagaaagttttcaattctaacagatgctttcaaagttgtgaaaattcccactgaagagagaaatcctgtcaatgtaagtaatatagaaagcgagatacaagatgattcatgtatagtcaggtaccacataatcatgtttcagtcagcaatggaccatataggttggtagccccataagattatttaagtgtttacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439446 - DNA, 868 bp, Homo sapiens
tgcaatccagcctgggcaacagagcgagactctgtctcaaaaaaaaaaaaaaaaaaagaggggctgggcatggtggctcatgcttgtcctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439447 - DNA, 3048 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggttgcagtgagccgagattgcaccattgcactcctccataggcaccaagagctgaactctgtataaaaaaaaaaa

SEQ ID NO: 439448 - DNA, 2626 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagtgagccgagattgcaccattgtactccaatccggacaatagttgcgagactatgtatca

SEQ ID NO: 439449 - DNA, 2832 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaaaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagaaatggggtttcgccgtgttgcccaggctactcttgaactcctgggttcagtgaagtagtctgcctgcctcagcttcccaaagtgttggaattacaggtgtgatccaccacacctgaccagggctcgagtttctccatatcctcctcaacgtttgttactcttttttattatagccatactagtggatatagggtatctcgttgtagttttgattggcatttccctaataattactgatgttgagcatctcttgtgcttaaggccatttgtttattgtctgtagtgaaatgtttattcaaatcttttgcccatttttaaaagggggttggttattcgttaacaagaattcattactctagacataaagtctcatcagattttttctcctattctgtgactttctcagtagtatcttttgaagcgtttactttttgatgaagtcctatttatcatttttaaaaattgcttttgcagttttatggttatctaagaaacattgcctaattaaaggtaatgaaaatttactcgtacgtttaagagtttataattttggctcctacatttaggtctgtgatctatattgttttgtttatagtgagaggtaagggtataatttatctttttgcatgtgggtgtgtgattattccagcaccttttattgaaaagactgtcccttccctattgaattgccgtagcatcttatgaaaatcaattgaccataaatataagggtttatttccggattctgagttctcttttgttctgtaggtgtatccttcatgctaatactgcactgtcttactgactgtagctttatagtgaattttgaaatttggaattataagccctctaactttttcaggaatgttttgactatgccgggtcctgtacagttccatacaaattgtccatttctgccaaaaaaaaaaaaccaaaaaaacagctggagttttggtaggaattgccttgaacctatagatcaatttggggagactcactgtcaacaacgttgagttttccaatccatgacacagaggtctctttatttaatttctctcagcagtgttttgtagttgttcggtgtacgagtcttgaattttttttgttaaatttattgccaagtattttattctttttccatgctgtcttgaatggtggaagtgttttctaattttcgttttcaggttgttaacgctaacctgtagaaatacaatcgatttgtccattgctcttgtatccttcgcccttgctgaactcaccagttgtagtagtttctttgtgaattccttacagttttctacatacaggatctgttatctgcaaataaagagcattttacttcttt

SEQ ID NO: 439450 - DNA, 1892 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggagagagctgatagtattcattccactcttttcataattggtcagaacagttagaaattgcttttaactatagtcatgcattgcttaacaatgggtatacattctgagagatacatctttaggcgatttcatcatcgtgccaacatcataaagtgtacttacacaaacctacgtggtacagcctactacatacctaggctttatgggatagtctgttgcttctaggctacaaacctgtacagcatgttactgtactaaatactgtaggcagttataacacaacggtaagtatttgtgtatttaaacatagaaaaggtacagtaaaaatataatataaaagataaaaaatggtatacctgtgtaggacacctaccatgaatggaccttaaaggattggaagttgtttgggtgagtgagtgagtggtaagtgaatgcaaaggcctaggactactgtgtgcaacttttaaaactaaaaagtttttatttttagcaacttttaaaactaaaaagtttttatttttaaaaacttttaaaactttaccaaaaacaaagacacaagccggacgcaatggtgcacagctgtagccctagctacttaggaagctgaggtggggggattgcttgagtcctgaaatttgaatctagattgggcaacgttgtgagacctcatatttataaaaaaacaaaactaagacacatacacacaccttaacctaggcctgcacaaggtcagggtcatcaatatcactggtcttccacctccagatcttgtcccactcaaggccttcaggggcagcaacacacatggacctgtcatttcctatgataacagtgctgtcttttggaataccttctgaaggacctgcttgaggctgttttacagttaactttttttttgtaggtagaaaacatatactctaatgataaaaagtatagtatagtaaacacataaactagtagcatagctgtttattatcaggtatt

SEQ ID NO: 439451 - DNA, 1564 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggagagagctgatagtattcattccactcttttcataattggtcagaacagttagaaattgcttttaactatagtcatgcattgcttaacaatgggtatacattctgagagatacatctttaggcgatttcatcatcgtgccaacatcataaagtgtacttacacaaacctacgtggtacagcctactacatacctaggctttatgggatagtctgttgcttctaggctacaaacctgtacagcatgttactgtactaaatactgtaggcagttataacacaacggtaagtatttgtgtatttaaacatagaaaaggtacagtaaaaatataatataaaagataaaaaatggtatacctgtgtaggacacctaccatgaatggaccttaaaggattggaagttgtttgggtgagtgagtgagtggtaagtgaatgcaaaggcctaggactactgtgtgcaacttttaaaactaaaaagtttttatttttagcaacttttaaaactaaaaagtttttatttttaaaaacttttaaaactttaccaaaaacaaagacacaagccggacgcaatggtgcacagctgtagccctagctacttaggaagctgaggtggggggattgcttgagtcctgaaatttgaatctagattgggcaacgttgtgagacctcatatttataaaaaaacaaaactaagacacatacacacaccttaacctaggcctgcacaaggtcagggtcatcaatatcactggtcttccacctccagatcttgtcccactcaaggccttcaggggcagcaacacacatggacctgtcatttcctatgataacagtgctgtcttttggaataccttctgaaggacctgcttgaggctgttttacagttaactttttttttgtaggtagaaaacatatactctaatgataaaaagtatagtatagtaaacacataaactagtagcatagctgtttattatcaggtatt

SEQ ID NO: 439452 - DNA, 1225 bp, Homo sapiens
ttttctctgcctcccccaaccccctgttgtttttatggtcagctttgcattttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataaataagttttttttttttttttgcaggagagctgatagtattcattccactcttttcataattggtcagaacagttagaaattgcttttaactatagtcatgcattgcttaacaatgggtatacattctgagagatacatctttaggcgatttcatcatcgtgccaacatcataaagtgtacttacacaaacctacgtggtacagcctactacatacctaggctttatgggatagtctgttgcttctaggctacaaacctgtacagcatgttactgtactaaatactgtaggcagttataacacaacggtaagtatttgtgtatttaaacatagaaaaggtacagtaaaaatataatataaaagataaaaaatggtatacctgtgtaggacacctaccatgaatggaccttaaaggattggaagttgtttgggtgagtgagtgagtggtaagtgaatgcaaaggcctaggactactgtgtgcaacttttaaaactaaaaagtttttatttttagcaacttttaaaactaaaaagtttttatttttaaaaacttttaaaactttaccaaaaacaaagacacaagccggacgcaatggtgcacagctgtagccctagctacttaggaagctgaggtggggggattgcttgagtcctgaaatttgaatctagattgggcaacgttgtgagacctcatatttataaaaaaacaaaactaagacacatacacacaccttaacctaggcctgcacaaggtcagggtcatcaatatcactggtcttccacctccagatcttgtcccactcaaggccttcaggggcagcaacacacatggacctgtcatttcctatgataacagtgctgtcttttggaataccttctgaaggacctgcttgaggctgttttacagttaactttttttttgtaggtagaaaacatatactctaatgataaaaagtatagtatagtaaacacataaactagtagcatagctgtttattatcaggtatt

SEQ ID NO: 439453 - DNA, 1658 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggtatttagctgactcgccacactccacggaagcatatgaaatgatctgtgcagtgctctgagccctaggattcatctttcttttcaccgtagtggcctgactggcattgtatttaggcaaacttcatccactaagaacatcggaacttacacgaacacgtacctacggtggaagctcaattgcactaaggtcccatcaaaagggaggcggattggcaacaagggagggtcaaaacacgagatttccccaactctcgggaagccaagacacagacagaacagccgccacaacgacaccaacacaacaacgacacacgcacaaacaaaaaaaacagcggggcgcgaacacgggcccacaccaccaccacacacgccacacagcaaaacacacggccacaacacagcacagagcggcgaccccgcgcgccacaccacacaaaaggtg

SEQ ID NO: 439454 - DNA, 1200 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggagagagctgatagtattcattccactcttttcataattggtcagaacagttagaaattgcttttaactatagtcatgcattgcttaacaatgggtatacattctgagagatacatctttaggcgatttcatcatcgtgccaacatcataaagtgtacttacacaaacctacgtggtacagcctactacatacctaggctttatgggatagtctgttgcttctaggctacaaacctgtacagcatgttactgtaccttttctatgtttaaatacacaaatacttaccgttgt

SEQ ID NO: 439455 - DNA, 404 bp, Homo sapiens
tataaaaatctgacctagaagacatttcactattttattcctacttctgtgccaggagtgggttgtttttgtgtgcttatgttagaaggcattgatttgtatcaagccattggtagtgtgacctaaaagtctatatatgtttgatgaaatattcagttgaagaattggctttgagaatctgaaagtaaaatttgctattgatgtgtatctatataaagtgatggcagttactttttaatttttaatttttttttttttttttttgcaggagagctgatagtattcattccactcttttcataattggtcagaacagttagaaattgcttttaactatagtcatgcattgcttaacaatgggtatacattctgagagatacatctttaggcgatttcatcatcgt

SEQ ID NO: 439456 - DNA, 4024 bp, Homo sapiens
agcggagagctcggcggctgggactggaggacagcggtggcggaggcgactagcggcggcgggagcggcgccgagaggccgtgcgggacgcgggcgccaggaccggccgaacgcagaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439457 - DNA, 4685 bp, Homo sapiens
ctaatttttgtattttcaggagagacgggggtttcaccatgttggccaggatggtctcaatcttttgaccttgtgatccgcccaccttggcctcccaaagtgctgggattacaggcatgagtcaccgcgcccagccaatatgctatatttttgtatgactggcagcaccgtaggtttgtttacaccaatgtcaccacaaacaagtgagtaacgtgctgcgctgtgatattaccacagctatcatgttaaccaggtaataggaggttttcagttccattataatcttaagggaccaccattgtatatgtggtctgttgaccaaatattgttacacagcacatgaccataaaagaataacttagtaataactataccttctagctataatcttcagggtattctttatctgagtttcataagtatagctaaggtctgtggaatttatagcaactatcgtgtgtgggtgtgggtgtgtttgtgtgtgtgtgtgtgtgtttaatggagatggcgtctcactatgttggctaggttgggcttgaactcctggcctcaagctgtcctccctcctcagcctcctaaattgctgggattacaggcatgagccactgcacccagcctatcgtctgttgttaaatgttctaatgcacctattaggtgcacagagtactgttatatactcagaataaaatttacataatgctttaaatctcacaaaattgttttgataaacatactcttataattcttgcaacaccttgggaaatagttggttctatattactgttttatagctgaggagaaagactcacatcatttactaagatcatatagctagctagtaaatgtttgagtgaaaatacaaacaaaggttttctgactttaagagcttgagttttttccactataccatattgcatctgttgtaattgttaactaatgtgcattttaaaattctcatttgtcttatgtactgagcccttataccagtgctaatttatgtgactcctttctcctgcagctaagagaaaaatacctttttaattcatttatagtacccagtttttaaagaagatttattttgtaaaattttgcttatggtacatgtcatcttagcctgtaaataaattaaagcattaatttttatccctccctggtcttttcctccttctgactttatacgtctttctagagagcttatcttctataataacaattctttgttttaaagttgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439458 - DNA, 3492 bp, Homo sapiens
tcccattctgtaggttgcctgttcactctgatgatagtttcttatgctgtgcagaagctctttaattagatcccatttgtcaattttggcttttgttgccattgcttttggtgttttagtcatgaagtctttgcccatgccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439459 - DNA, 4459 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccaggaactccgacccacctggtgcagaggagtcttgtcttgacctgctttgggagagtgttgtcttgatgcttttctcttcctccttggaaaacagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439460 - DNA, 2528 bp, Homo sapiens
  misc_feature (22)..(23): n is a, c, g, or t
  misc_feature (27)..(27): n is a, c, g, or t
gcaggctggtaccgaccgcggnngtanggatatcgtcgaccacggcgctcgagtaagactctgaggatgaagagccgtcacctaagagagttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439461 - DNA, 3999 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttataggagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctaaaaaaaaatagcttatatttaaagg

SEQ ID NO: 439462 - DNA, 2887 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagaaatggggtttcgccgtgttgcccaggctactcttgaactcctgggttcagtgaagtagtctgcctgcctcagcttcccaaagtgttggaattacaggtgtgatccaccacacctgaccagggctcgagtttctccatatcctcctcaacgtttgttactcttttttattatagccatactagtggatatagggtatctcgttgtagttttgattggcatttccctaataattactgatgttgagcatctcttgtgcttaaggccatttgtttattgtctgtagtgaaatgtttattcaaatcttttgcccatttttaaaagggggttggttattcgttaacaagaattcattactctagacataaagtctcatcagattttttctcctattctgtgactttctcagtagtatcttttgaagcgtttactttttgatgaagtcctatttatcatttttaaaaattgcttttgcagttttatggttatctaagaaacattgcctaattaaaggtaatgaaaatttactcgtacgtttaagagtttataattttggctcctacatttaggtctgtgatctatattgttttgtttatagtgagaggtaagggtataatttatctttttgcatgtgggtgtgtgattattccagcaccttttattgaaaagactgtcccttccctattgaattgccgtagcatcttatgaaaatcaattgaccataaatataagggtttatttccggattctgagttctcttttgttctgtaggtgtatccttcatgctaatactgcactgtcttactgactgtagctttatagtgaattttgaaatttggaattataagccctctaactttttcaggaatgttttgactatgccgggtcctgtacagttccatacaaattgtccatttctgccaaaaaaaaaaaaccaaaaaaacagctggagttttggtaggaattgccttgaacctatagatcaatttggggagactcactgtcaacaacgttgagttttccaatccatgacacagaggtctctttatttaatttctctcagcagtgttttgtagttgttcggtgtacgagtcttgaattttttttgttaaatttattgccaagtattttattctttttccatgctgtcttgaatggtggaagtgttttctaattttcgttttcaggttgttaacgctaacctgtagaaatacaatcgatttgtccattgctcttgtatccttcgcccttgctgaactcaccagttgtagtagtttctttgtgaattccttacagttttctacatacaggatctgttatctgcaaataaagagcattttacttcttt

SEQ ID NO: 439463 - DNA, 2037 bp, Homo sapiens
  misc_feature (1809)..(1809): n is a, c, g, or t
  misc_feature (1818)..(1819): n is a, c, g, or t
  misc_feature (1825)..(1827): n is a, c, g, or t
  misc_feature (1835)..(1835): n is a, c, g, or t
  misc_feature (1840)..(1840): n is a, c, g, or t
  misc_feature (1851)..(1851): n is a, c, g, or t
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagaaatggggtttcgccgtgttgcccaggctactcttgaactcctgggttcagtgaagtagtctgcctgcctcagcttcccaaagtgttggaattacaggtgtgatccaccacacctgaccagggctcgagtttctccatatcctcctcaacgtttgttactcttttttattatagccatactagtggatatagggtatctcgttgtagttttgattggcatttccctaataattactgatgttgagcaaaaaaaaaaaaaaaaaaaaanttggggggnngggccnnnaaaagttntaaancatggtggggngcggggcccataggcaaggtgcaaacggggcacaagcgtgttcccggagaaaaccccgcgcaagaaaacaggtgcgttggagtctcccaagtaaaaacgcccgggggaacagcaggtttcgtaacaatccgaagggaattaggggacaataggggcaatcaacagggaccagggaccgataaaatc

SEQ ID NO: 439464 - DNA, 1722 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagaaatggggtttcgccgtgttgcccaggctactcttgaactcctgggttcagtgaagtagtctgcctgcctcagcttcccaaagtgttggaattacaggtgtgatccaccacacctgaccagggctcgagtttctccatatcaggatctgttatctgcaaataaagagcattttacttcttt

SEQ ID NO: 439465 - DNA, 1100 bp, Homo sapiens
gagtgtgggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccattcttttttttgtttggagacagagttttgctcttgttgcccaggctggagtgcaatggcacgatcttggctcaccgcaacctccgtctcctgggttcaagcaattcttctgcctc

SEQ ID NO: 439466 - DNA, 1158 bp, Homo sapiens
atttcttccttccttcattcagttggtcactcagtgaactatcatgaattgagcaccgcctctgtttcttatcaacaaaggagactgcggaaaagaagagtgactaagatctctgaagaagggaaaagctagatgactgggccacaagaggaaaaaaagcagcaagacagttacaattgtttctggtcccacttttataaacacacacacacacacacacacacacacacacacacacacacaatcatttaatcatttttaagtatttaatcattttttaaaaatctgtgatgctttacctgggcatgtctaggcaggtcctcctttgctaggacgtgcccttttctgtcccggaatactctaaacttggcattttggcagcgtgaagttttcccgttgtgactttctccttgttcccttttctcctccttctttgcagacaatgagtagccactgctgtttgccctggcccatcaatgagaagatctgctcttagagccctgctttcctgctgaaggccctgaaatcacctgtgttccaggccacctgctaacaataaataatgctgccctgatgtggggaattagctcaagtggtagagcgcttgcttagcacgcaagaggtagtgggatcgatgcccacattctccaagctttattatttagacatcgtgtctccaaacactcaggtctccaaacccaagttagtgtctgagaacaggatgctgctttggttcaagacgtaggagcagcaataatagagggctggtgatggctccctcttggcattcagtatagtgtagatctaccatgtaattaattctctgtttctttgaggagctgtgaaaccaagggacatatacaactgctcttttctccctgtttctacctgcagctttgtcctaaatgtgagacaattatgaaaagtgcagcgcagagccacttgggtaaatacagccccggctttctgctcaggggacagagtttgaggcactgcagaggaaccggccaaagtatgagacccatatattgagagtaacagagtgtaaagttcaaaaaaaatcaaaatatttaaagatttatcatgggtcttgatgacatgatggaatctctctactctctggacttattatgtgtggtaataaatttactttttaaa

SEQ ID NO: 439467 - DNA, 1297 bp, Homo sapiens
atttcttccttccttcattcagttggtcactcagtgaactatcatgaattgagcaccgcctctgtttcttatcaacaaaggagactgcggaaaagaagagtgactaagatctctgaagaagggaaaagctagatgactgggccacaagaggaaaaaaagcagcaagacagttacaattgtttctggtcccacttttataaacacacacacacacacacacacacacacacacacacacacacaatcatttaatcatttttaagtatttaatcattttttaaaaatctgtgatgctttacctgggcatgtctaggcaggtcctcctttgctaggacgtgcccttttctgtcccggaatactctaaacttggcattttggcagcgtgaagttttcccgttgtgactttctccttgttcccttttctcctccttctttgcagacaatgagtagccactgctgtttgccctggcccatcaatgagaagatctgctcttagagccctgctttcctgctgaaggccctgaaatcacctgtgttccaggccacctgctaacaataaataatgctgccctgatgtggggaattagctcaagtggtagagcgcttgcttagcacgcaagaggtagtgggatcgatgcccacattctccaagctttattatttagacatcgtgtctccaaacactcaggtctccaaacccaagttagtgtctgagaacaggatgctgctttggttcaagacgtaggagcagcaataatagagggctggtgatggctccctcttggcattcagtatagtgtagatctaccatgtaattaattctctgtttctttgaggagctgtgaaaccaagggacatatacaactgctcttttctccctgtttctacctgcagctttgtcctaaatgtgagacaattatgaaaagtgcagcgcagagccacttgggtaaatacagccccggctttctgctcaggggacagagtttgaggcactgcagaggaaccggccaaagtatgagacccatatattgagagtaacagagtgtaaagttcaaaaaaaatcaaaatatttaaagatttatcatgggtcttgatgacatgatggaatctctctactctctggacttattatgtgtggtaataaatttactttttaaagcccaaaaaaaaaaaaaatggccctggttggcccaaccggtggaatctctgcgacccgttcccttttaggagggattattagatggtccctcggtacaatagcttaactggactccaagatatagacttcacccaaaaa

SEQ ID NO: 439468 - DNA, 2648 bp, Homo sapiens
acctgccgagctgtggggaaacctttatccagaattcacaactcactgcacatcagaagacacacacaaagaagaggaatgctgagaagtaagatgagttgggaaatactcttgactgaatttaatccttcaaaacaatcagataattcacacaagaggtacaccttatgaatcgcatcaatagagggaaattttcagctacaatctttgctctctctgtgtatcagcaaatacatagagagattctgtacatttatttgggagaaaattttatcatattttaggcttttctaaatattagataatatagatggcagaagtcatgcaaattgtaaaacaggaaggaaacctttcagaagtcatacttttgttttgcaacatagaagtcacacaggagaaaaatcctgtaagtaaaacgaatgtcaagacattttctgtcagggcagccagctgtagacatccaaaagctcacaaatgagaagctccttgagtatctagaaatctctttacacaattggagctcatgtactagagaattcaaagggataactgcaaagacactggtagatatagaagcctttattaagaattgatgtttcattcaatttcagatcactggtacttggatagatattttaaatatttggaaggtgttcaataaaaattcaaataatttgtactgagggaaacagttatactacaaatcatgttgcagatctgatgccgagattgctctattttaaaaggaaacctgcaaatgtctacatatatgaagcttttaaaaagcacaagttatcaggcaacatcattaaacatacattaaatgtctgttagcatataggattttgtgcgtatgtgagtgtgctataacatgtaacttgcggatgttcagcgtgcatgtggaatccatccataatggtacatagcgaaataatataatcttagttcagtaactattatgtgtatgaagatgttgcacattaagtctcagtagtgactctggttgttaatatttgtattgtaagtgtaatattccttttaaattataaggcatctttttatccttttttgtgtttgtaaatggatatagacagtggtaataactaatccttcaaaaataagttaaaatgtttttgtaaaattttcaaatgtcagtcaagttttgcattagggacacatttatatatagcaaaagcctgagctgtttttaaacagctaaaaacagtagtatttattacaatctccacaatgaaaacaaatagtgcaatgtaagaaatattatgtatcttactgttgatgtgtgatcagggagcagagctatctgcatttgtatttagtgtgagagtcctaaatgttcttcaccaactttttcttcctcatagaagcaacatggcatagttaagggtgtggactctgggctcctgctgcctgggccccgattccagcatggggcatgctacttaatatctctgtgcctcagttcccatcccataaaagagtagtgatagtgacaacatcttaggattgctttgaggtctaaatgagttaacattttcaaagcacttagaatagtgtctgagacacaagagctatatgttagaggttatcatcattatttgtattttgtgaattacgctgcaaaaaaaaaaaaaatgttggctacccaacattcattccccaccttcttgctgccagtgccttgatttggttgtttgttgtttgtttgttttcctacaagtgatttaggggcagatcctgactacactaagtcagggtttgacaaatgacagtccatcagacagatctggcccactacccatttttgtatcctgcaagctaagaatggttttatatttctaaatggttgaaagaatcaaagaatattgtgacacatgaaaattatatgatattcaaatttcagtgtccataaataaagttttgaaaacatgaatacaaacaaaaaacacctatttatgtttgacctgtggctgtctttgcactaccccagcagagttgagtagttgtagcagacaccacatgcccttgagcctaagatctagcactttacaaagtaagtttttctgttacttagagctgaaaataaaagcaatgtagagttacgcttttataagtatttcatgtttcagaaatgatgcatacagcaatttgtaggtgggtggttttttgcagtatatttattttgtgcattatatttatatgttaagagcctgagcttagaagtatttttttcaaagaaatgtgttttttacttgctaaattgtcataacatcaaaacaagaaatttcttgatggaatgtagcagtaaacatatgaaataaacattgtctaaattaagtcgaattgttcattgatactgccccacagtattcctttgttttctcccaaatcaatggccagttttccctgtatcattttataattttctttctatcccataagataccattggtaagtcatacttagctaacgtaacccaataacaaaaaacttacaatacccaattccatcagctacattactagtaatctataaaattattgcctgcacttcatgtaattgtcatatgctgctacaatctaaacctgccagcgtcttacttccccttcctaataaagactttcattgat

SEQ ID NO: 439469 - DNA, 2594 bp, Homo sapiens
acctgccgagctgtggggaaacctttatccagaattcacaactcactgcacatcagaagacacacacaaagaagaggaatgctgagaagtaagatgagttgggaaatactcttgactgaatttaatccttcaaaacaatcagataattcacacaagaggtacaccttatgaatcgcatcaatagagggaaattttcagctacaatctttgctctctctgtgtatcagcaaatacatagagagattctgtacatttatttgggagaaaattttatcatattttaggcttttctaaatattagataatatagatggcagaagtcatgcaaattgtaaaacaggaaggaaacctttcagaagtcatacttttgttttgcaacatagaagtcacacaggagaaaaatcctgtaagtaaaacgaatgtcaagacattttctgtcagggcagccagctgtagacatccaaaagctcacaaatgagaagctccttgagtatctagaaatctctttacacaattggagctcatgtactagagaattcaaagggataactgcaaagacactggtagatatagaagcctttattaagaattgatgtttcattcaatttcagatcactggtacttggatagatattttaaatatttggaaggtgttcaatagatctgatgccgagattgctctattttaaaaggaaacctgcaaatgtctacatatatgaagcttttaaaaagcacaagttatcaggcaacatcattaaacatacattaaatgtctgttagcatataggattttgtgcgtatgtgagtgtgctataacatgtaacttgcggatgttcagcgtgcatgtggaatccatccataatggtacatagcgaaataatataatcttagttcagtaactattatgtgtatgaagatgttgcacattaagtctcagtagtgactctggttgttaatatttgtattgtaagtgtaatattccttttaaattataaggcatctttttatccttttttgtgtttgtaaatggatatagacagtggtaataactaatccttcaaaaataagttaaaatgtttttgtaaaattttcaaatgtcagtcaagttttgcattagggacacatttatatatagcaaaagcctgagctgtttttaaacagctaaaaacagtagtatttattacaatctccacaatgaaaacaaatagtgcaatgtaagaaatattatgtatcttactgttgatgtgtgatcagggagcagagctatctgcatttgtatttagtgtgagagtcctaaatgttcttcaccaactttttcttcctcatagaagcaacatggcatagttaagggtgtggactctgggctcctgctgcctgggccccgattccagcatggggcatgctacttaatatctctgtgcctcagttcccatcccataaaagagtagtgatagtgacaacatcttaggattgctttgaggtctaaatgagttaacattttcaaagcacttagaatagtgtctgagacacaagagctatatgttagaggttatcatcattatttgtattttgtgaattacgctgcaaaaaaaaaaaaaatgttggctacccaacattcattccccaccttcttgctgccagtgccttgatttggttgtttgttgtttgtttgttttcctacaagtgatttaggggcagatcctgactacactaagtcagggtttgacaaatgacagtccatcagacagatctggcccactacccatttttgtatcctgcaagctaagaatggttttatatttctaaatggttgaaagaatcaaagaatattgtgacacatgaaaattatatgatattcaaatttcagtgtccataaataaagttttgaaaacatgaatacaaacaaaaaacacctatttatgtttgacctgtggctgtctttgcactaccccagcagagttgagtagttgtagcagacaccacatgcccttgagcctaagatctagcactttacaaagtaagtttttctgttacttagagctgaaaataaaagcaatgtagagttacgcttttataagtatttcatgtttcagaaatgatgcatacagcaatttgtaggtgggtggttttttgcagtatatttattttgtgcattatatttatatgttaagagcctgagcttagaagtatttttttcaaagaaatgtgttttttacttgctaaattgtcataacatcaaaacaagaaatttcttgatggaatgtagcagtaaacatatgaaataaacattgtctaaattaagtcgaattgttcattgatactgccccacagtattcctttgttttctcccaaatcaatggccagttttccctgtatcattttataattttctttctatcccataagataccattggtaagtcatacttagctaacgtaacccaataacaaaaaacttacaatacccaattccatcagctacattactagtaatctataaaattattgcctgcacttcatgtaattgtcatatgctgctacaatctaaacctgccagcgtcttacttccccttcctaataaagactttcattgat

SEQ ID NO: 439470 - DNA, 235 bp, Homo sapiens
ccattcattcattcattcaacaatattcattcaacaaatgaagcaaaggagcacacagccaagtgatggagcaaaatcacaaattaaaaggtaattcaggccaggtgaggtggctcatgcctgcaatcccaatgcctgtaatcctctggaaggtgggaggatcacttgaggtcaggagttcaagaccagcctggccaacatggcgaaacccccatctctactaaaaatacaaaaa

SEQ ID NO: 439471 - DNA, 350 bp, Homo sapiens
aactgtgcatattcgaggaggcagaggaagaaaggaagaggaaggttttcaaagagaaagcagcagtgaggatgccagagttcatgggtttctagaagacaagttttcaactgcagatacaaacatcaggacgtcaatgtatctgctaggagacacccggacagtgttgagaacacagaacctggaggctaaacccccagctttctatgccagctgagagtctgtgggcacattactcagcgtctctgaacctcatgctcctcccctgtgacatgtagattgctaaacccatctcacagggctatcttctgcatttaaagaataaaataacacatgaggggtcgttggcc

SEQ ID NO: 439472 - DNA, 851 bp, Homo sapiens
ttgatatttatattttgaaatttattatttctatattgttgagttattttagtcatagttataaactgtcagtgggaaaataaatctaagttgctggccattcttagttatagtttctgaggaataaaggtaagttctgagataaagcagtacttgagactataaatacactaacttaataaattggtctttattggttcatatttttgggttatattaattttcaaaacattgaaagtaaatttggtatcttttttcccctctctaggctgaagggtatgtgattggcagctgtattaaacacattccaatcgcaggacgagatataacatattttattcagcaactgctgagagaccgagaagtaggaatccctccagaacaatccttggaaactgctaaggcagtaaaggtaaaaagtgtgataggagtgtaatttagttaaaaattaaaatcacatttataacattaacgtgagaaatttttaatagaagaagagtacttgaaataatcttgttaaccagttataaattattacccttaaatatatttacattttctttgtgtttcttaaaagaaaattattacagcagtttgtcttctgttttcttcatattttatatttgagaggagtaatataagaacattttaccaaatgacattaacataaatttttgtgattattctctttattaaaaataaataattatttcactataaagtccttgcatctcagtttcttcactgaattctttattttaattctaaaagcttttgtcataaaaattattttgatacaattgattcattgtgctatagtatagaagcagtgcttggctcaagtgataggg

SEQ ID NO: 439473 - DNA, 667 bp, Homo sapiens
tcatcagaaggtccttgtttgttctgtttaagtatttaaaaacattaaggtaaaagttaagcttcattgcatagaaagtatgatgttttacactgaataaagggaattattctaagaatcctgtccccaaattaaaatgtctttaaagccccctaaaaaggtgttctagtgttctaataccattaacctaggaagtattggtgctttgttctggtagtgcatgcaatattaaaatgaaggagcttttatctgaattattgaataactgtacaactttggatttaaaaccatttccaacataagaggtgaaagttatttttttcctcaattttagtcttcttcaattgggccatataacctagttgagtttgtgactttgccttgagaaatgaggtaacacagcatggaacagtctatcttttccagaccttgaatgaggaaggcaaatgatctagacatttcttagaactagacgaaaaatagtcatagcatgactaggagtagttttatctgtagttaggcgaatgccaggtatggacatgcattggtcgcatactgtttagaaatcgggacagtcacgaccagatgcactggccgatcagtttgacacttacagctatggccaagcgctgccgtcggtttacaactgacagcatgcatgcctgcc

SEQ ID NO: 439474 - DNA, 799 bp, Homo sapiens
tatgtttttgcttaatcctggaatatgtatatgatagtttcagaattgttaatccacaccactgtgaaaaatagacccaaaactagaattcaatatttgcttatattttatcttcagcctgaaggcttataagattcaaaatactatgctcacaagttgcttgtgttagtccctttcctcaccttagtgtgcttatgtttgaaaaaagtacaattagtttaatttgtttttgttgtactttgttttgccccaacctccccttcttttaaggtgttattttttagtatgtaaaacactaacatttagattcttaaagtcagaactgtataaaacatgtgctcattgttatttcccttccatttattctgctctgttccctccctgtctcttccacagtgttcccaacccctttcctctgagacagccaatctcaattgtttctggtttgtaagataccacctgaatttagtacagatattatttttgtatatgtacatttaaggttaaatgacacagaagttgttatttgaatttactatgaagatgatcatactatgtctttctttagccaaaacctattgatgtacaagtcattacacaccacatgcagcgatatgcagtttggtttggaggatcaatgctggcttccacgcctgagtctaccaagttgcacaccagggtcttgagaattggcctcccttgcgccccatcccggtgcggctgtctcctgctccatctcgcgggcgcggcggggccacctgatacgggcgccgcagcgctcggggcaccgctgactccc

SEQ ID NO: 439475 - DNA, 397 bp, Homo sapiens
tcaatccttgccctgtgggatttgagaaactacaatggccagtgactgccatgtgcttcctgagcctctctgttactgacagtagtcttatttgctgttattgagtgttactccatcattgcacattgagtttatgcatgtgtgtcctttagttgataggccactgagctatgggcagccacatgtgttcctgatggaagggactgagtatctcccagagatcctggacacgaggagacatgctgtgagtggatgtctggaagccagtcctgagagagaagactctaaatccagaatttcttcaggcatttcaaacatttctatgttgtgtgcattatataaacaacacctatataacttgtcttaagaaaataaaagcaacaagattaactgaaaa

SEQ ID NO: 439476 - DNA, 253 bp, Homo sapiens
gttcggtcctcttagacccagacgtgtgcatggtcgtactcttaggtcctgggcgcctgagttttcgccggtcccccaccaaaaaaagggccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagta

SEQ ID NO: 439477 - DNA, 3141 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagta

SEQ ID NO: 439478 - DNA, 3587 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaaagtgatgaaaataaattaaaactgaattacc

SEQ ID NO: 439479 - DNA, 3532 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatctacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaaagtgatgaaaataaattaaaactgaattacc

SEQ ID NO: 439480 - DNA, 3522 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaaagtgatgaaaataaattaaaactgaattacc

SEQ ID NO: 439481 - DNA, 3462 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttccttggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaaagtgatgaaaataaattaaaactgaattacc

SEQ ID NO: 439482 - DNA, 2122 bp, Homo sapiens
ggctaggtacgaggctgggtgttgaatcggccgaggcagaactgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaaagtgatgaaaataaattaaaactgaattacc

SEQ ID NO: 439483 - DNA, 2737 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgcagcagtgaggatgccagagttcatgggtttctagaagacaagttttcaactgcagatacaaacatcaggacgtcaatgtatctgctaggagacacccggacagtgttgagaacacagaacctggaggctaaacccccagctttctatgccagctgagagtctgtgggcacattactcagcgtctctgaacctcatgctcctcccctgtgacatgtagattgctaaacccatctcacagggctatcttctgcatttaaagaataaaataacacatgaggggtcgttggcc

SEQ ID NO: 439484 - DNA, 2464 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcttgaagtttccaaagttgccacccaaaaaggattatgaagcttataggtatggggtaagggagtgtgaagagatacccttcggtacccgctaggttgatgctggtttat

SEQ ID NO: 439485 - DNA, 2295 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaaggttggttttcccaattattggtgag

SEQ ID NO: 439486 - DNA, 1885 bp, Homo sapiens
tatgtttttgcttaatcctggaatatgtatatgatagtttcagaattgttaatccacaccactgtgaaaaatagacccaaaactagaattcaatatttgcttatattttatcttcagcctgaaggcttataagattcaaaatactatgctcacaagttgcttgtgttagtccctttcctcaccttagtgtgcttatgtttgaaaaaagtacaattagtttaatttgtttttgttgtactttgttttgccccaacctccccttcttttaaggtgttattttttagtatgtaaaacactaacatttagattcttaaagtcagaactgtataaaacatgtgctcattgttatttcccttccatttattctgctctgttccctccctgtctcttccacagtgttcccaacccctttcctctgagacagccaatctcaattgtttctggtttgtaagataccacctgaatttagtacagatattatttttgtatatgtacatttaaggttaaatgacacagaagttgttatttgaatttactatgaagatgatcatactatgtctttctttagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaaagtgatgaaaataaattaaaactgaattacc

SEQ ID NO: 439487 - DNA, 2489 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaatgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaaagtgatgaaaataaattaaaactgaattacc

SEQ ID NO: 439488 - DNA, 2109 bp, Homo sapiens
tcatcagaaggtccttgtttgttctgtttaagtatttaaaaacattaaggtaaaagttaagcttcattgcatagaaagtatgatgttttacactgaataaagggaattattctaagaatcctgtccccaaattaaaatgtctttaaagccccctaaaaaggtgttctagtgttctaataccattaacctaggaagtattggtgctttgttctggtagtgcatgcaatattaaaatgaaggagcttttatctgaattattgaataactgtacaactttggatttaaaaccatttccaacataagaggtgaaagttatttttttcctcaattttagtcttcttcaattgggccatataacctagttgagtttgtgactttgccttgagaaatgaggtaacacagcatggaacagtctatcttttccagaccttgaatgaggaaggcaaatgatctagacatttcttagaactagacgaaaaatagtcatagcatgactaggagtagttttatctgtagttaggcgaatgccgcttctttacattattggtgcaatgaaagtatgggaaagtctcaacagaacagactggacatttgagaaccttccatttttcaaaatttcagaatcctcgcagcaggtgtgtgagacaaggattggggacaggagttaattgctcttttggagttccgataaagatttatagctgattttaagtcatggctgctagaatttctaagctttcatgccatgaatggactaataataaacattttagacttaacatctattttaaagcatcactcttaaagtttatttcaatataccttcaagatggtagatttttgacccttataaaaatacatattttttgttttcagcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaaagtgatgaaaataaattaaaactgaattacc

SEQ ID NO: 439489 - DNA, 1796 bp, Homo sapiens
taggtctccctgcttccttttgccagaaaaggtaaagttctggagaaagaggttttttcttggcttttgagttcaggccttacagaggtaaaaccgagtagatgtgggagaacatgtggtaaacagatacaactttcccgggatggggagagaaaaatagtgaaactccatctccactaaaaatacaaatactagcccggccgtggtggcacgcgcctgtaatcccaactacttgggaggctgcggcaggtgaatcacttgaagccgggaggtgaaggccgcagtaacgctgttccctgcattggatgaagtgctccccaccaaactctctcaccggagagggtgggatctgcgggctccctgggtggcttgatttcgacaccctgtgggctgccttccactctggtactttcctctgcctgctgatgcttgaaattccttgaaccggccacacacacctgctttctggaatcagaacactggaaaggcttcctgggacgggagaagagtgatttacattcctgccgaggtgtaaagctgcggatggcaggttctctcctgagaaccggcttcaactaggaggaggaggttggaagcaggaccccgagctgacctgttgaccaggagaggagtaagcagaagggaggcaggagcgggcggaggagagaaggccggggagccgggatgggggtcaccgcccccggggagccgggatgggggtcaccgcccccggggagccgggatgggggtcaccgcccccgcccccgtgatgccgagctgaaaaagacagtctccaggtaggataatccgtcacactagatgcatatagcttcatgcaagaagagcgactgttgcgctgtcttctaccccctttggccgcgatcccgtgacaatgccggcatccgggcaccaactggcttttgcgaaccgctctccgctccccgcccggattccgaagcccggagccgtttacagtttgaggcgccgtgtgccgccccctggtggccggaggccgttactgtcgcggctgagggggcgtcccggtgtatccgcagcgcgccctggccgccctctggtggccggaggccgttactgtcgcggctgagggggcgtcccggtgtatccgcagcgcgccctggccgccccctggtggccggaggccgttactgtcgcggctgagggggcgtcccggtgtatccgcagcgcgccctggccgacccctggtggccggaggccgttactgtcgcggctgaaggggcgtgtcccggtgtatccgcagcgcgccctggctgccccctggtggccggaggccgttactgtcgcggctgagggggcgtcccggtgtatccgcagcgcgccctgtcccgccatatacattccgtgcttttcaaacacccgccgtgggctaagcatgggacccacgtggggcggggacacacggcgataaagagccaggccctcgctgccaaggagctttcccgtaacaccgatgcatcaaacaaaaggcagcagtgaggatgccagagttcatgggtttctagaagacaagttttcaactgcagatacaaacatcaggacgtcaatgtatctgctaggagacacccggacagtgttgagaacacagaacctggaggctaaacccccagctttctatgccagctgagagtctgtgggcacattactcagcgtctctgaacctcatgctcctcccctgtgacatgtagattgctaaacccatctcacagggctatcttctgcatttaaagaataaaataacacatgaggggtcgttggcc

SEQ ID NO: 439490 - DNA, 1767 bp, Homo sapiens
taggtctccctgcttccttttgccagaaaaggtaaagttctggagaaagaggttttttcttggcttttgagttcaggccttacagaggtaaaaccgagtagatgtgggagaacatgtggtaaacagatacaactttcccgggatggggagagaaaaatagtgaaactccatctccactaaaaatacaaatactagcccggccgtggtggcacgcgcctgtaatcccaactacttgggaggctgcggcaggtgaatcacttgaagccgggaggtgaaggccgcagtaacgctgttccctgcattggatgaagtgctccccaccaaactctctcaccggagagggtgggatctgcgggctccctgggtggcttgatttcgacaccctgtgggctgccttccactctggtactttcctctgcctgctgatgcttgaaattccttgaaccggccacacacacctgctttctggaatcagaacactggaaaggcttcctgggacgggagaagagtgatttacattcctgccgaggtgtaaagctgcggatggcaggttctctcctgagaaccggcttcaactaggaggaggaggttggaagcaggaccccgagctgacctgttgaccaggagaggagtaagcagaagggaggcaggagcgggcggaggagagaaggccggggagccgggatgggggtcaccgcccccggggagccgggatgggggtcaccgcccccgcccccgtgatgccgagctgaaaaagacagtctccaggtaggataatccgtcacactagatgcatatagcttcatgcaagaagagcgactgttgcgctgtcttctaccccctttggccgcgatcccgtgacaatgccggcatccgggcaccaactggcttttgcgaaccgctctccgctccccgcccggattccgaagcccggagccgtttacagtttgaggcgccgtgtgccgccccctggtggccggaggccgttactgtcgcggctgagggggcgtcccggtgtatccgcagcgcgccctggccgccctctggtggccggaggccgttactgtcgcggctgagggggcgtcccggtgtatccgcagcgcgccctggccgccccctggtggccggaggccgttactgtcgcggctgagggggcgtcccggtgtatccgcagcgcgccctggccgacccctggtggccggaggccgttactgtcgcggctgaaggggcgtgtcccggtgtatccgcagcgcgccctggctgccccctggtggccggaggccgttactgtcgcggctgagggggcgtcccggtgtatccgcagcgcgccctgtcccgccatatacattccgtgcttttcaaacacccgccgtgggctaagcatgggacccacgtggggcggggacacacggcgataaagagccaggccctcgctgccaaggagctttcccgtaacaccgatgcatcaaacaaaaggcagcagtgaggatgccagagttcatgggtttctagaagacaagttttcaactgcagatacaaacatcaggacgtcaatgtatctgctaggagacacccggacagtgttgagaacacagaacctggaggctaaacccccagctttctatgccagctgagagtctgtgggcacattactcagcgtctctgaacctcatgctcctcccctgtgacatgtagattgctaaacccatctcacagggctatcttctgcatttaaagaataaaataacacatgaggggtcgttggcc

SEQ ID NO: 439491 - DNA, 1775 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgattgtgaagctcatctcatttgaaaatttttggttaacctagaaaagtatagtaaagaatagaatcatcacttgtaatcatacttctcagagactctctgtttacattttgaaatacttcaaatgtaatgtaaggaaatactttccttctgtctcttctccccctgtatttatcacagagacctgatttttttggttagttttttaaaactaaaaaccatactcttgtagcctccttgatcgccca

SEQ ID NO: 439492 - DNA, 1498 bp, Homo sapiens
taggtctccctgcttccttttgccagaaaaggtaaagttctggagaaagaggttttttcttggcttttgagttcaggccttacagaggtaaaaccgagtagatgtgggagaacatgtggtaaacagatacaactttcccgggatggggagagaaaaatagtgaaactccatctccactaaaaatacaaatactagcccggccgtggtggcacgcgcctgtaatcccaactacttgggaggctgcggcaggtgaatcacttgaagccgggaggtgaaggccgcagtaacgctgttccctgcattggatgaagtgctccccaccaaactctctcaccggagagggtgggatctgcgggctccctgggtggcttgatttcgacaccctgtgggctgccttccactctggtactttcctctgcctgctgatgcttgaaattccttgaaccggccacacacacctgctttctggaatcagaacactggaaaggcttcctgggacgggagaagagtgatttacattcctgccgaggtgtaaagctgcggatggcaggttctctcctgagaaccggcttcaactaggaggaggaggttggaagcaggaccccgagctgacctgttgaccaggagaggagtaagcagaagggaggcaggagcgggcggaggagagaaggccggggagccgggatgggggtcaccgcccccggggagccgggatgggggtcaccgcccccggggagccgggatgggggtcaccgcccccgcccccgtgatgccgagctgaaaaagacagtctccaggtaggataatccgtcacactagatgcatatagcttcatgcaagaagagcgactgttgcgctgtcttctaccccctttggccgcgatcccgtgacaatgccggcatccgggcaccaactggcttttgcgaaccgctctccgctccccgcccggattccgaagcccggagccgtttacagtttgaggcgccgtgtgccgccccctggtggccggaggccgttactgtcgcggctgagggggcgtcccggtgtatccgcagcgcgccctgtcccgccatatacattccgtgcttttcaaacacccgccgtgggctaagcatgggacccacgtggggcggggacacacggcgataaagagccaggccctcgctgccaaggagctttcccgtaacaccgatgcatcaaacaaaaggcagcagtgaggatgccagagttcatgggtttctagaagacaagttttcaactgcagatacaaacatcaggacgtcaatgtatctgctaggagacacccggacagtgttgagaacacagaacctggaggctaaacccccagctttctatgccagctgagagtctgtgggcacattactcagcgtctctgaacctcatgctcctcccctgtgacatgtagattgctaaacccatctcacagggctatcttctgcatttaaagaataaaataacacatgaggggtcgttggcc

SEQ ID NO: 439493 - DNA, 1441 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaaggcaccaccatacagacgcaccac

SEQ ID NO: 439494 - DNA, 1298 bp, Homo sapiens
tcatcagaaggtccttgtttgttctgtttaagtatttaaaaacattaaggtaaaagttaagcttcattgcatagaaagtatgatgttttacactgaataaagggaattattctaagaatcctgtccccaaattaaaatgtctttaaagccccctaaaaaggtgttctagtgttctaataccattaacctaggaagtattggtgctttgttctggtagtgcatgcaatattaaaatgaaggagcttttatctgaattattgaataactgtacaactttggatttaaaaccatttccaacataagaggtgaaagttatttttttcctcaattttagtcttcttcaattgggccatataacctagttgagtttgtgactttgccttgagaaatgaggtaacacagcatggaacagtctatcttttccagaccttgaatgaggaaggcaaatgatctagacatttcttagaactagacgaaaaatagtcatagcatgactaggagtagttttatctgtagttaggcgaatgccgcttctttacattattggtgcaatgaaagtatgggaaagtctcaacagaacagactggacatttgagaaccttccatttttcaaaatttcagaatcctcgcagcaggtgtgtgagacaaggattggggacaggagttaattgctcttttggagttccgataaagatttatagctgattttaagtcatggctgctagaatttctaagctttcatgccatgaatggactaataataaacattttagacttaacatctattttaaagcatcactcttaaagtttatttcaatataccttcaagatggtagatttttgacccttataaaaatacatattttttgttttcagcctgagttctaccaagtatgccacaccaaaaaggattatgaagaaattggacctagcatttgtcgtcacaatccagtgtttggagtcatgtcgtaaaattggcttcatagttattggggttagggaggtgggcagcagtgaggatgccagagttcatgggtttctagaagacaagttttcaactgcagatacaaacatcaggacgtcaatgtatctgctaggagacacccggacagtgttgagaacacagaacctggaggctaaacccccagctttctatgccagctgagagtctgtgggcacattactcagcgtctctgaacctcatgctcctcccctgtgacatgtagattgctaaacccatctcacagggctatcttctgcatttaaagaataaaataacacatgaggggtcgttggcc

SEQ ID NO: 439495 - DNA, 714 bp, Homo sapiens
gcgcagttctggtaacagctatatcacgtgttaggatatatcgagacacaagtagtctcttgacattggtgcttacacacctctgtgagatagttttctccgaaaccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaaagtgatgaaaataaattaaaactgaattacc

SEQ ID NO: 439496 - DNA, 426 bp, Homo sapiens
ttgttgacagatggtggttgctatttcaggcccagacataatcaaatccatgtgaagaaaagagatttcttcctgcgtggccctttgtaagagaaagaaaatgttcctacaagtcttccagaggagttcttaatggcagcagtgaggatgccagagttcatgggtttctagaagacaagttttcaactgcagatacaaacatcaggacgtcaatgtatctgctaggagacacccggacagtgttgagaacacagaacctggaggctaaacccccagctttctatgccagctgagagtctgtgggcacattactcagcgtctctgaacctcatgctcctcccctgtgacatgtagattgctaaacccatctcacagggctatcttctgcatttaaagaataaaataacacatgaggggtcgttggcc

SEQ ID NO: 439497 - DNA, 497 bp, Homo sapiens
ggattatagtttactgaaaacatgccattcttctttactgttcctataataagcaaaaaaagttacttttgtttctttgtttttcaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagaggtaattttttttaacggaattgtttaaaagtattcagcagcaaatatgaattaatagatattcagagagaattaatctcagaaacttttattagtacactaaaagtttgagtttttatgaaaagtttataaaacattttatgaactttttaaagaaaaaatttgcttttgttaaaataagcaaaattgttgctattttttgcagatttagaaaaaactttttaaaaaatatgtgtg

SEQ ID NO: 439498 - DNA, 370 bp, Homo sapiens
caaatgtaaacctctaagtttgtcttaataaaatgtagggagtgagctattttattgcataatacaaaattaattttatgtattttctttccacagatactacatttaaaattgaataaagtactccagggaactagttttttttttttcgattaactctttgtttttttgttttttttttttgtttttttgcctttcttctttctttgtgctcagctgttcttgccttagctgcatcttggacctcaagacaagtaggagaacggacgttgaccggtacggtaatagacagtggagatggtgtcactcatgtcattcctgtggtaaggctattttacagttactgaacagaacatgaaataacacatct

SEQ ID NO: 439499 - DNA, 3128 bp, Homo sapiens
ttttttttttgttaagacaggaaacacatttattgagagcacagtggggtgcgccaaccctgtgctttggaaccgcatcacagcgcccctcacaacagccctgtgaggtaggtgaaggagcccacttcccacatgcagacactgaaggctcaacagctcccctaggcctcagggttctcacattgccataccctcctcatggcccccttcactcataacagtacctgcctagacctcgaagcactagtttccaaccctgcttgagttaactacttccatgacaactgtgcaaggccagagtgtgggcagctaccttgagggccaccggcatgggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagta

SEQ ID NO: 439500 - DNA, 3252 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaa

SEQ ID NO: 439501 - DNA, 3423 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtaaaaaaaaaaaaaaaaaaaaaacaaaaaaaaaaaaaaaaaaacaaaaaaaaaaagggggggcgccgcccaagaaaattaccccccgaaggggggccacacgattagacagctacacccacgatatttgctggtaaccaagggggccccacaatagggggggagctattagaaagcagacgacacacgggcgacgggcgttaaaaaaacatcaaggagagagaaaaaagtgtgagaggggagaacacttggggaaaaaggaaaccagaatcagcgcgaggcaaa

SEQ ID NO: 439502 - DNA, 3117 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaa

SEQ ID NO: 439503 - DNA, 2776 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtgggcagcagtgaggatgccagagttcatgggtttctagaagacaagttttcaactgcagatacaaacatcaggacgtcaatgtatctgctaggagacacccggacagtgttgagaacacagaacctggaggctaaacccccagctttctatgccagctgagagtctgtgggcacattactcagcgtctctgaacctcatgctcctcccctgtgacatgtagattgctaaacccatctcacagggctatcttctgcatttaaagaataaaataacacatgaggggtcgttggcc

SEQ ID NO: 439504 - DNA, 2579 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggaattaaaataaaagaccctttgtaaatgcagacttagaagaaatactgaatttgtgtcagaagttctccagtgtttgtgttaatcgtctagaca

SEQ ID NO: 439505 - DNA, 1393 bp, Homo sapiens
gtagatgtacaagtcattacacaccacatgcagcgatatgcagttggtttggaggatcaatgctggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaaagtgatgaaaataaattaaaactgaattacc

SEQ ID NO: 439506 - DNA, 2316 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggtaaaaagtgtgataggagtgtaatttagttaaaaattaaaatcacatttataacattaacgtgagaaatttttaatagaagaagagtacttgaaataatcttgttaaccagttataaattattacccttaaatatatttacattttctttgtgtttcttaaaagaaaattattacagcagtttgtcttctgttttcttcatattttatatttgagaggagtaatataagaacattttaccaaatgacattaacataaatttttgtgattattctctttattaaaaataaataattatttcactataaagtccttgcatctcagtttcttcactgaattctttattttaattctaaaagcttttgtcataaaaattattttgatacaattgattcattgtgctatagtatagaagcagtgcttggctcaagtgataggg

SEQ ID NO: 439507 - DNA, 1786 bp, Homo sapiens
tgtgcgtgagatattggttatacgggcagtcaacaagggagtatacagagtataagatggtgggcaagaccagtggtgggaacaagataccacgtattccgcgggaattggggcaagaaaaatagagtagtgaaaagttccatgcctgtcccttatatattgcgataacttaggcccccgccgtgggttgccaacggccgcccaagtaagtcggccacgtacttgggaggctgcggcaggtgaatcacttgaagccgggaggtgaaggccgcagtaacgctgttccctgcattggatgaagtgctccccaccaaactctctcaccggagagggtgggatctgcgggctccctgggtggcttgatttcgacaccctgtgggctgccttccactctggtactttcctctgcctgctgatgcttgaaattccttgaaccggccacacacacctgctttctggaatcagaacactggaaaggcttcctgggacgggagaagagtgatttacattcctgccgaggtgtaaagctgcggatggcaggttctctcctgagaaccggcttcaactaggaggaggaggttggaagcaggaccccgagctgacctgttgaccaggagaggagtaagcagaagggaggcaggagcgggcggaggagagaaggccggggagccgggatgggggtcaccgcccccggggagccgggatgggggtcaccgcccccggggagccgggatgggggtcaccgcccccgcccccgtgatgccgagctgaaaaagacagtctccaggtaggataatccgtcacactagatgcatatagcttcatgcaagaagagcgactgttgcgctgtcttctaccccctttggccgcgatcccgtgacaatgccggcatccgggcaccaactggcttttgcgaaccgctctccgctccccgcccggattccgaagcccggagccgtttacagtttgaggcgccgtgtgccgccccctggtggccggaggccgttactgtcgcggctgagggggcgtcccggtgtatccgcagcgcgccctggccgccctctggtggccggaggccgttactgtcgcggctgagggggcgtcccggtgtatccgcagcgcgccctggccgccccctggtggccggaggccgttactgtcgcggctgagggggcgtcccggtgtatccgcagcgcgccctggccgacccctggtggccggaggccgttactgtcgcggctgaaggggcgtgtcccggtgtatccgcagcgcgccctggctgccccctggtggccggaggccgttactgtcgcggctgagggggcgtcccggtgtatccgcagcgcgccctgtcccgccatatacattccgtgcttttcaaacacccgccgtgggctaagcatgggacccacgtggggcggggacacacggcgataaagagccaggccctcgctgccaaggagctttcccgtaacaccgatgcatcaaacaaaaggcagcagtgaggatgccagagttcatgggtttctagaagacaagttttcaactgcagatacaaacatcaggacgtcaatgtatctgctaggagacacccggacagtgttgagaacacagaacctggaggctaaacccccagctttctatgccagctgagagtctgtgggcacattactcagcgtctctgaacctcatgctcctcccctgtgacatgtagattgctaaacccatctcacagggctatcttctgcatttaaagaataaaataacacatgaggggtcgttggcc

SEQ ID NO: 439508 - DNA, 1570 bp, Homo sapiens
ggagggatggggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcagggtcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccttggtcctctggcctccttggtgcctctgg

SEQ ID NO: 439509 - DNA, 1750 bp, Homo sapiens
taggtctccctgcttccttttgccagaaaaggtaaagttctggagaaagaggttttttcttggcttttgagttcaggccttacagaggtaaaaccgagtagatgtgggagaacatgtggtaaacagatacaactttcccgggatggggagagaaaaatagtgaaactccatctccactaaaaatacaaatactagcccggccgtggtggcacgcgcctgtaatcccaactacttgggaggctgcggcaggtgaatcacttgaagccgggaggtgaaggccgcagtaacgctgttccctgcattggatgaagtgctccccaccaaactctctcaccggagagggtgggatctgcgggctccctgggtggcttgatttcgacaccctgtgggctgccttccactctggtactttcctctgcctgctgatgcttgaaattccttgaaccggccacacacacctgctttctggaatcagaacactggaaaggcttcctgggacgggagaagagtgatttacattcctgccgaggtgtaaagctgcggatggcaggttctctcctgagaaccggcttcaactaggaggaggaggttggaagcaggaccccgagctgacctgttgaccaggagaggagtaagcagaagggaggcaggagcgggcggaggagagaaggccggggagccgggatgggggtcaccgcccccggggagccgggatgggggtcaccgcccccggggagccgggatgggggtcaccgcccccgcccccgtgatgccgagctgaaaaagacagtctccaggtaggataatccgtcacactagatgcatatagcttcatgcaagaagagcgactgttgcgctgtcttctaccccctttggccgcgatcccgtgacaatgccggcatccgggcaccaactggcttttgcgaaccgctctccgctccccgcccggattccgaagcccggagccgtttacagtttgaggcgccgtgtgccgccccctggtggccggaggccgttactgtcgcggctgagggggcgtcccggtgtatccgcagcgcgccctggccgccctctggtggccggaggccgttactgtcgcggctgagggggcgtcccggtgtatccgcagcgcgccctggccgccccctggtggccggaggccgttactgtcgcggctgagggggcgtcccggtgtatccgcagcgcgccctggccgacccctggtggccggaggccgttactgtcgcggctgaaggggcgtgtcccggtgtatccgcagcgcgccctggctgccccctggtggccggaggccgttactgtcgcggctgagggggcgtcccggtgtatccgcagcgcgccctgtcccgccatatacattccgtgcttttcaaacacccgccgtgggctaagcatgggacccacgtggggcggggacacacggcgataaagagccaggccctcgctgccaaggagctttcccgtaacaccgatgcatcaaacaaaagttgataggccactgagctatgggcagccacatgtgttcctgatggaagggactgagtatctcccagagatcctggacacgaggagacatgctgtgagtggatgtctggaagccagtcctgagagagaagactctaaatccagaatttcttcaggcatttcaaacatttctatgttgtgtgcattatataaacaacacctatataacttgtcttaagaaaataaaagcaacaagattaactgaaaa

SEQ ID NO: 439510 - DNA, 4165 bp, Homo sapiens
gctgacctgaggagtcgcggctgcgagcaggttagagttacttgttattggtaaatagccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgactgagatcagaggccctgtgacgattgtgtcaggtaaaaagcgcagactcaccattattgaatgtgggtgtgacattaacatgatgattgatctggctaaagtagcagatctggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccgggtgccaagctgttctacctttctggaatggtgcatggagaatatcaaaaccaagaaatccacaatctgggccgttttattacagttatgaagtttaggcctctcacatggcaaacttctcacccttatatcctggcagacaggatggaagatttgacaaacccagaggatatccgaacaaacatcaaatgtgaccggaaggtgtcactttatggttatttaagaggagcacacttgaaaaataaaagccaaattcacatgccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggatgaagtggggcccacccatgagctggtccagagtctcatctctacccactccaccattgatgccaagatggcttcaagtcgagtgacgctgttttctgattccaagccacttgggtcagaggatatagataatcaagggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggggccacagaacttcattgatgagaccagtgatatagaaaatttactcaaagaggaagaagattacaaggaagaaaataatgattccaaagaaacgtcaggtgccctcaagtggaaggaagacctttccagaaaggcagctgaggcctttctgaggcagcagcaagcagctccaaacctccgaaagcttatttatgggacagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggttatgaacagtatcagagattgcttcgtgactggaaagtgggaagatgataaagatgcagccaaggtcttagcagaagatgaggagctctacggtgactttgaagacttggaaacaggggacgtgcacaagggaaaatcaggccccaatactcagaatgaagatatagagaaagaagttaaggaagaaattgaccccgacgaagaagaaagtgccaagaaaaagcatttggataagaagagaaaattgaaggagatgtttgatgcagaatatgatgaaggagaaagcacatattttgatgatcttaaaggagaaatgcagaaacaagcacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggccctatcactccacagggaactggtttcttggcaatacagtctgtcagtggcataatgcctgattttcggatagctgctacaggagttgtccttgatctggataaatccataaaaattgtgaagaaattaaagctaactggttttccatataaaattttcaagaacacttcatttattaagggaatgtttaattctgccttggaagtggccaaatttgaaggtgctgtgattcgaacagtcagtgggataagggggcagatcaagaaagcactccgagctccagaaggagctttcagggccagctttgaggataagctgctgatgagcgatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcgtcagactaaaggcgaacaaggactctctgtataagccaatcctgaggcaaaagaaacattttaattcactgcacattccagcaggcaaggtgccaaaggacaggcggagaccggccgtcatacgcgagcctcatgaaagaaagatccttgcactgctggatgctctgagtacggtgcatagtcagaagatgaagaaggccaaggagcagcggcacctgcacaataaagagcacttcagagccaagcagaaggaggaggaggagaagctgaagcggcagaaggacctcaggaagaagctcttcagaattcaggggcagaaggaaagaagaaaccagaagtccagtttgaagggggctgagggccaattgcagtgagcctttggactggagggactgtccctggatctgcggaggtagacagtttcaaacatcacagtttgaatgcctgtgaatgacacgtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttac

SEQ ID NO: 439511 - DNA, 4460 bp, Homo sapiens
gctgacctgaggagtcgcggctgcgagcaggttagagttacttgttattggtaaatagccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgactgagatcagaggccctgtgacgattgtgtcaggtaaaaagcgcagactcaccattattgaatgtgggtgtgacattaacatgatgattgatctggctaaagtagcagatctggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccgggtgccaagctgttctacctttctggaatggtgcatggagaatatcaaaaccaagaaatccacaatctgggccgttttattacagttatgaagtttaggcctctcacatggcaaacttctcacccttatatcctggcagacaggatggaagatttgacaaacccagaggatatccgaacaaacatcaaatgtgaccggaaggtgtcactttatggttatttaagaggagcacacttgaaaaataaaagccaaattcacatgccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggatgaagtggggcccacccatgagctggtccagagtctcatctctacccactccaccattgatgccaagatggcttcaagtcgagtgacgctgttttctgattccaagccacttgggtcagaggatatagataatcaagggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggggccacagaacttcattgatgagaccagtgatatagaaaatttactcaaagaggaagaagattacaaggaagaaaataatgattccaaagaaacgtcaggtgccctcaagtggaaggaagacctttccagaaaggcagctgaggcctttctgaggcagcagcaagcagctccaaacctccgaaagcttatttatgggacagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggttatgaacagtatcagagattgcttcgtgactggaaagtgggaagatgataaagatgcagccaaggtcttagcagaagatgaggagctctacggtgactttgaagacttggaaacaggggacgtgcacaagggaaaatcaggccccaatactcagaatgaagatatagagaaagaagttaaggaagaaattgaccccgacgaagaagaaagtgccaagaaaaagcatttggataagaagagaaaattgaaggagatgtttgatgcagaatatgatgaaggagaaagcacatattttgatgatcttaaaggagaaatgcagaaacaagcacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggccctatcactccacagggaactggtttcttggcaatacagtctgtcagtggcataatgcctgattttcggatagctgctacaggagttgtccttgatctggataaatccataaaaattgtgaagaaattaaagctaactggttttccatataaaattttcaagaacacttcatttattaagggaatgtttaattctgccttggaagtggccaaatttgaaggtgctgtgattcgaacagtcagtgggataagggggcagatcaagaaagcactccgagctccagaaggagctttcagggccagctttgaggataagctgctgatgagcgatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcgtcagactaaaggcgaacaaggactctctgtataagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaagatccttgcactgctggatgctctgagtacggtgcatagtcagaagatgaagaaggccaaggagcagcggcacctgcacaataaagagcacttcagagccaagcagaaggaggaggaggagaagctgaagcggcagaaggacctcaggaagaagctcttcagaattcaggggcagaaggaaagaagaaaccagaagtccagtttgaagggggctgagggccaattgcagtgagcctttggactggagggactgtccctggatctgcggaggtagacagtttcaaacatcacagtttgaatgcctgtgaatgacacgtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttacaaaagaaagaagagaaaaaaaaaaaaaaaaaaaaaaaaaaaaaataaaaaaaaataaaaataaaaaaaaaaaaaaaacttgagggggggcccggggcccaattggccctatagggagttgtattacaattcattggcctgagttgtacaacgttttaactgggccgtgaagaacccaactaaatcgcccttgagcaaatcccctttttgccagttggcggaatatgcaggatgtggccgtt

SEQ ID NO: 439512 - DNA, 3916 bp, Homo sapiens
gctgacctgaggagtcgcggctgcgagcaggttagagttacttgttattggtaaatagccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgactgagatcagaggccctgtgacgattgtgtcaggtaaaaagcgcagactcaccattattgaatgtgggtgtgacattaacatgatgattgatctggctaaagtagcagatctggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccgggtgccaagctgttctacctttctggaatggtgcatggagaatatcaaaaccaagaaatccacaatctgggccgttttattacagttatgaagtttaggcctctcacatggcaaacttctcacccttatatcctggcagacaggatggaagatttgacaaacccagaggatatccgaacaaacatcaaatgtgaccggaaggtgtcactttatggttatttaagaggagcacacttgaaaaataaaagccaaattcacatgccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggatgaagtggggcccacccatgagctggtccagagtctcatctctacccactccaccattgatgccaagatggcttcaagtcgagtgacgctgttttctgattccaagccacttgggtcagaggatatagataatcaagggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggggccacagaacttcattgatgagaccagtgatatagaaaatttactcaaagaggaagaagattacaaggaagaaaataatgattccaaagaaacgtcaggtgccctcaagtggaaggaagacctttccagaaaggcagctgaggcctttctgaggcagcagcaagcagctccaaacctccgaaagcttatttatgggacagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggttatgaacagtatcagagattgcttcgtgactggaaagtgggaagatgataaagatgcagccaaggtcttagcagaagatgaggagctctacggtgactttgaagacttggaaacaggggacgtgcacaagggaaaatcaggccccaatactcagaatgaagatatagagaaagaagttaaggaagaaattgaccccgacgaagaagaaagtgccaagaaaaagcatttggataagaagagaaaattgaaggagatgtttgatgcagaatatgatgaaggagaaagcacatattttgatgatcttaaaggagaaatgcagaaacaagcacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggccctatcactccacagggaactggtttcttggcaatacagtctgtcagtggcataatgcctgattttcggatagctgctacaggagttgtccttgatctggataaatccataaaaattgtgaagaaattaaagctaactggttttccatataaaattttcaagaacacttcatttattaagggaatgtttaattctgccttggaagtggccaaatttgaaggtgctgtgattcgaacagtcagtgggataagggggcagatcaagaaagcactccgagctccagaaggagctttcagggccagctttgaggataagctgctgatgagcgatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcgtcagactaaaggcgaacaaggactctctgtataagccaatcctgaggcaaaagaaacattttaattcactgcacattccaaaagccttgcagaaggccctgccatttaagaacaagcccaagacccaagcaaaggcaggcaaggtgccaaaggacaggcggaggtagacagtttcaaacatcacagtttgaatgcctgtgaatgacacgtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttac

SEQ ID NO: 439513 - DNA, 1319 bp, Homo sapiens
gctgacctgaggagtcgcggctgcgagcaggttagagttacttgttattggtaaatagccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgactgagatcagaggccctgtgacgattgtgtcaggtaaaaagcgcagactcaccattattgaatgtgggtgtgacattaacatgatgattgatctggctaaagtagcagatctggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccgggtgccaagctgttctacctttctggaatggtgcatggagaatatcaaaaccaagaaatccacaatctgggccgttttattacagttatgaagtttaggcctctcacatggcaaacttctcacccttatatcctggcagacaggatggaagatttgacaaacccagaggatatccgaacaaacatcaaatgtgaccggaaggtgtcactttatggttatttaagaggagcacacttgaaaaataaaagccaaattcacatgccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggatgaagtggggcccacccatgagctggtccagagtctcatgacttggggctgtcgagatttaaagtgatgtaagctgtggttatgtggattctcttactttcctctgcctgcctcagtttaattattttgtcctacagaaatatcattaaaatatttttttgttac

SEQ ID NO: 439514 - DNA, 285 bp, Homo sapiens
gcagctgaggcctttctgaggcagcagcaagcagctccaaacctccgaaagcttatttatgggacaggtaaagaattctggttcagaactagaaatgttttagtttctctgattatttagatgagggaattggttggaggattcggctggtattgttgacatccataattgctgtccatcacatttcatatttgacagatgtctctaatcatcagcttatgaggaccacacattggtcttataaagtagacttatgggtttgctgtaaaacttgatgcaaatacc

SEQ ID NO: 439515 - DNA, 366 bp, Homo sapiens
gtaaaaagcgcagactcaccattattgaatgtgggtgtgacattaacatgatgattgatctggctaaagtagcagatctggtaagtgagcaggggcagcctggggtgctgatggagacttacagcattgtgataggttatttaccccgtgatgaagggaagagagtcttataattattaaaagaatcatggtcatcatcagtgatacggtagatatgattgaattgatgataattatggtaataaatgttgttatgttaataataaaaatggaatgtgcacaatgaaatgtgttccaaaatctaaaagcaaatcacaggatggagaaaacctttaatgaacacaactaataagagctcattaatat

SEQ ID NO: 439516 - DNA, 516 bp, Homo sapiens
tgaaatttccatgaaaagaaactgggatctattcatctgttctgttgagaccccatagttccataccatagaaatgggcacagtgggttttggggggagagttgtaagtgtaagctgtctgttcctctgtttactgagaattgtgggtgtccactgaggcagttcatatttggcagatgattgagtcctgatttctcagggccggcagattctggtgttactgatcttgtggaaaagtcaacccattgagaagattttatgcagaagttttaaatgcacattgatcataatttgaatatgtcacagtctttgtttttcttttcagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaagaaaggtactgttgcccatgctgtactgca

SEQ ID NO: 439517 - DNA, 544 bp, Homo sapiens
ataagcacctcagtggcccaaagacaaggcctgaaatttccatgaaaagaaactgggatctattcatctgttctgttgagaccccatagttccataccatagaaatgggcacagtgggttttggggggagagttgtaagtgtaagctgtctgttcctctgtttactgagaattgtgggtgtccactgaggcagttcatatttggcagatgattgagtcctgatttctcagggccggcagattctggtgttactgatcttgtggaaaagtcaacccattgagaagattttatgcagaagttttaaatgcacattgatcataatttgaatatgtcacagtctttgtttttcttttcagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaagaaaggtactgttgcccatgctgtact

SEQ ID NO: 439518 - DNA, 4219 bp, Homo sapiens
gctgacctgaggagtcgcggctgcgagcaggttagagttacttgttattggtaaatagccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgactgagatcagaggccctgtgacgattgtgtcaggtaaaaagcgcagactcaccattattgaatgtgggtgtgacattaacatgatgattgatctggctaaagtagcagatctggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccgggtgccaagctgttctacctttctggaatggtgcatggagaatatcaaaaccaagaaatccacaatctgggccgttttattacagttatgaagtttaggcctctcacatggcaaacttctcacccttatatcctggcagacaggatggaagatttgacaaacccagaggatatccgaacaaacatcaaatgtgaccggaaggtgtcactttatggttatttaagaggagcacacttgaaaaataaaagccaaattcacatgccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggatgaagtggggcccacccatgagctggtccagagtctcatctctacccactccaccattgatgccaagatggcttcaagtcgagtgacgctgttttctgattccaagccacttgggtcagaggatatagataatcaagggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggggccacagaacttcattgatgagaccagtgatatagaaaatttactcaaagaggaagaagattacaaggaagaaaataatgattccaaagaaacgtcaggtgccctcaagtggaaggaagacctttccagaaaggcagctgaggcctttctgaggcagcagcaagcagctccaaacctccgaaagcttatttatgggacagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggttatgaacagtatcagagattgcttcgtgactggaaagtgggaagatgataaagatgcagccaaggtcttagcagaagatgaggagctctacggtgactttgaagacttggaaacaggggacgtgcacaagggaaaatcaggccccaatactcagaatgaagatatagagaaagaagttaaggaagaaattgaccccgacgaagaagaaagtgccaagaaaaagcatttggataagaagagaaaattgaaggagatgtttgatgcagaatatgatgaaggagaaagcacatattttgatgatcttaaaggagaaatgcagaaacaagcacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggccctatcactccacagggaactggtttcttggcaatacagtctgtcagtggcataatgcctgattttcggatagctgctacaggagttgtccttgatctggataaatccataaaaattgtgaagaaattaaagctaactggttttccatataaaattttcaagaacacttcatttattaagggaatgtttaattctgccttggaagtggccaaatttgaaggtgctgtgattcgaacagtcagtgggataagggggcagatcaagaaagcactccgagctccagaaggagctttcagggccagctttgaggataagctgctgatgagcgatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcgtcagactaaaggcgaacaaggactctctgtataagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaagatccttgcactgctggatgctctgagtacggtgcatagtcagaagatgaagaaggccaaggagcagcggcacctgcacaataaagagcacttcagagccaagcagaaggaggaggaggagaagctgaagcggcagaaggacctcaggaagaagctcttcagaattcaggggcagaaggaaagaagaaaccagaagtccagtttgaagggggctgagggccaattgcagtgagcctttggactggagggactgtccctggatctgcggaggtagacagtttcaaacatcacagtttgaatgcctgtgaatgacacgtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttac

SEQ ID NO: 439519 - DNA, 986 bp, Homo sapiens
taagtgagtccgacagtcacggtgggattggggcgcgcagatcagaccagcaatccgggctccgaaccgcgcgtgctagcgcagtttagtggataatctggtgcttagcgatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcgtcagactaaaggcgaacaaggactctctgtataagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaagatccttgcactgctggatgctctgagtacggtgcatagtcagaagatgaagaaggccaaggagcagcggcacctgcacaataaagagcacttcagagccaagcagaaggaggaggaggagaagctgaagcggcagaaggacctcaggaagaagctcttcagaattcaggggcagaaggaaagaagaaaccagaagtccagtttgaagggggctgagggccaattgcagtgagcctttggactggagggactgtccctggatctgcggaggtagacagtttcaaacatcacagtttgaatgcctgtgaatgacacgtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttac

SEQ ID NO: 439520 - DNA, 3837 bp, Homo sapiens
gctgacctgaggagtcgcggctgcgagcaggttagagttacttgttattggtaaatagccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgactgagatcagaggccctgtgacgattgtgtcaggtaaaaagcgcagactcaccattattgaatgtgggtgtgacattaacatgatgattgatctggctaaagtagcagatctggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccgggtgccaagctgttctacctttctggaatggtgcatggagaatatcaaaaccaagaaatccacaatctgggccgttttattacagttatgaagtttaggcctctcacatggcaaacttctcacccttatatcctggcagacaggatggaagatttgacaaacccagaggatatccgaacaaacatcaaatgtgaccggaaggtgtcactttatggttatttaagaggagcacacttgaaaaataaaagccaaattcacatgccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggatgaagtggggcccacccatgagctggtccagagtctcatctctacccactccaccattgatgccaagatggcttcaagtcgagtgacgctgttttctgattccaagccacttgggtcagaggatatagataatcaagggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggggccacagaacttcattgatgagaccagtgatatagaaaatttactcaaagaggaagaagattacaaggaagaaaataatgattccaaagaaacgtcaggtgccctcaagtggaaggaagacctttccagaaaggcagctgaggcctttctgaggcagcagcaagcagctccaaacctccgaaagcttatttatgggacagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggttatgaacagtatcagagattgcttcgtgactggaaagtgggaagatgataaagatgcagccaaggtcttagcagaagatgaggagctctacggtgactttgaagacttggaaacaggggacgtgcacaagggaaaatcaggccccaatactcagaatgaagatatagagaaagaagttaaggaagaaattgaccccgacgaagaagaaagtgccaagaaaaagcatttggataagaagagaaaattgaaggagatgtttgatgcagaatatgatgaaggagaaagcacatattttgatgatcttaaaggagaaatgcagaaacaagcacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggccctatcactccacagggaactggtttcttggcaatacagtctgtcagtggcataatgcctgattttcggatagctgctacaggagttgtccttgatctggataaatccataaaaattgtgaagaaattaaagctaactggttttccatataaaattttcaagaacacttcatttattaagggaatgtttaattctgccttggaagtggccaaatttgaaggtgctgtgattcgaacagtcagtgggataagggggcagatcaagaaagcactccgagctccagaaggagctttcagggccagctttgaggataagctgctgatgagcgatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcgtcagactaaaggcgaacaaggactctctgtataagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaagctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttac

SEQ ID NO: 439521 - DNA, 571 bp, Homo sapiens
ctgttcagaggatcccccaacgctctcattttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagac

SEQ ID NO: 439522 - DNA, 483 bp, Homo sapiens
  misc_feature (12)..(13): n is a, c, g, or t
  misc_feature (34)..(34): n is a, c, g, or t
  misc_feature (49)..(49): n is a, c, g, or t
  misc_feature (57)..(57): n is a, c, g, or t
  misc_feature (66)..(66): n is a, c, g, or t
  misc_feature (70)..(70): n is a, c, g, or t
taacgtcccttnncaaatggaagccctttagctngcgggaaccccaagntcaacccnataatattntganccttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaagaaggcttcttctctagtaacattagcatggtctaagagtgatcaccctattttttgtctaaaaccagtttatacaggtaccgagctcgattgt

SEQ ID NO: 439523 - DNA, 10794 bp, Homo sapiens
  misc_feature (2)..(2): n is a, c, g, or t
tncttttttttttaattgaggaatcaacagccgccatcttgtcgcggacccgaccggggcttcgagcgcgatctactcggccccgccggtcccgggccccacaaccgcccgcgcaccccgctccgcccggccggcccgctccgcccggccctcggcgcccgccccggcggccccgctcgcctctcggctcggcctcccggagcccggcggcggcggcggcggcagcggcggcggcggcggcggaacggggggtgggggggccgcggcggcggcggcgaccccgctcggcgcattgtttttcctcacggcggcggcggcggcgggccgcgggccgggagcggagcccggagccccctcgtcgtcgggccgcgagcgaattcattaagtggggcgcggggggggagcgaggcggcggcggcggcggcaccatgttctcggggactgcctgagccgcccggccgggcgccgtcgctgccagccgggcccgggggggcggccgggccgccggggcgcccccaccgcggagtgtcgcgctcgggaggcgggcaggggatgagggggccgcggccggcggcggcggcggcggccgggggcgggcggtgagcgctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439524 - DNA, 9205 bp, Homo sapiens
  misc_feature (2)..(2): n is a, c, g, or t
tncttttttttttaattgaggaatcaacagccgccatcttgtcgcggacccgaccggggcttcgagcgcgatctactcggccccgccggtcccgggccccacaaccgcccgcgcaccccgctccgcccggccggcccgctccgcccggccctcggcgcccgccccggcggccccgctcgcctctcggctcggcctcccggagcccggcggcggcggcggcggcagcggcggcggcggcggcggaacggggggtgggggggccgcggcggcggcggcgaccccgctcggcgcattgtttttcctcacggcggcggcggcggcgggccgcgggccgggagcggagcccggagccccctcgtcgtcgggccgcgagcgaattcattaagtggggcgcggggggggagcgaggcggcggcggcggcggcaccatgttctcggggactgcctgagccgcccggccgggcgccgtcgctgccagccgggcccgggggggcggccgggccgccggggcgcccccaccgcggagtgtcgcgctcgggaggcgggcaggggatgagggggccgcggccggcggcggcggcggcggccgggggcgggcggtgagcgctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggttttta

SEQ ID NO: 439525 - DNA, 10996 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggtagttttccagctccttccagggcgtgtcattcagtgagccgtgttaggatagaccagggctcttaagtgtcccagaggagcctgtgagccttcataggggattaaagtaaatgaaaccacaattaactaaccaaagtagttagttttgttttccattaaactagcgggaaatgaactgttgagatgactgcagtgagcgtgttttgtgtggcgagtctgtgtgggaccccgctcttacctaacgcaggtaaacctggggagttgggattgggacagcctggcacctgaaccagaggaagtaagctctgccacgagggcttcatgtgcagtcaggaatctgggcaagaaggaactaaaagtggcttttctcagtttgccttaactgtggctctctgtgccgagtggtgccattcatccttttgttcagtgacgaaaactgaattccatttaactgattggcagcagggttggtgactggttggtttttgggttttggtttgtttgtttgtttatcacatcctgtttggtggccagtgtaaataccatcaaaagaaaaactggccaatcacagcactgtgggaggccgaggtgggaggataactggaccacaggagtctgagacaagtctgaacaacaaagtgagaccctagctctacaaaaaataaattatctgggcatgatggtacatgccttgtcatcctaactatgtgggagtctgaggcaggaggattgcttgagcccatgaggttgaggttgcagtgagctgtgaccgcgtcaccgcattgcagcctgaatgacagagcaagaccctgtctaaaaagtaaacttccagggtgttgtttgttgcttgtgtttgatttcagatttgagggataccctgagttaaacatgtgcctccttcccacaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439526 - DNA, 9850 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagctgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439527 - DNA, 9374 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439528 - DNA, 8693 bp, Homo sapiens
gccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccacccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439529 - DNA, 8341 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439530 - DNA, 8309 bp, Homo sapiens
  misc_feature (2)..(2): n is a, c, g, or t
tncttttttttttaattgaggaatcaacagccgccatcttgtcgcggacccgaccggggcttcgagcgcgatctactcggccccgccggtcccgggccccacaaccgcccgcgcaccccgctccgcccggccggcccgctccgcccggccctcggcgcccgccccggcggccccgctcgcctctcggctcggcctcccggagcccggcggcggcggcggcggcagcggcggcggcggcggcggaacggggggtgggggggccgcggcggcggcggcgaccccgctcggcgcattgtttttcctcacggcggcggcggcggcgggccgcgggccgggagcggagcccggagccccctcgtcgtcgggccgcgagcgaattcattaagtggggcgcggggggggagcgaggcggcggcggcggcggcaccatgttctcggggactgcctgagccgcccggccgggcgccgtcgctgccagccgggcccgggggggcggccgggccgccggggcgcccccaccgcggagtgtcgcgctcgggaggcgggcaggggatgagggggccgcggccggcggcggcggcggcggccgggggcgggcggtgagcgctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaacc

SEQ ID NO: 439531 - DNA, 7128 bp, Homo sapiens
tcagtgctttctgatcattcacagctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439532 - DNA, 6763 bp, Homo sapiens
tggcagagcgcatcaccacattgcgcctggtttcctggacaagatgacatttacattgaaggtgcagaccattctagatacacaggcatgaaagaacacaggttgctccataaaactaccaggcccctagaatgggtggttgttagtccgagcttaacttcatgaagggcccttaccctgtctcttgacgtttagactttatcctataatgtgctgaggaggttttgaagaatagccctggttctagtgtaagagggtcatctttggtctatgaggtgaactgcactccagcctgggcaacagagcaagaccttgtctctgaaaaaacagaaggaaaagaaatgatagtggaatatgtagaaaaagacattgtagtgttctacgaaattaaattttctgttcattccgttattacatgtacttgagattttaaggggccatcatgtctttttgtttgaagaactagttacaaaataacattccagagaccctatagtttatactcaacagataaattttagttaataaaacatgttttcttattttaaaacaaggacagacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439533 - DNA, 6467 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaaggtaagtgaactgaagcactttcaatacttcctacctaaccgcgggctttccctccgagtaatgcgtaaaatgggaccacgtggcccactcctgtttttcctcttgggctctccacgtgccactcatgcttggaagagacagatttctttctaggataaagatctctgccccatttctgtctttaaaatgagaattcttaaagaagtagggacagcttgcaggtcaggcagtttacagcgtcagggcagtttacagcgtcagggcagtttacagcgtcagggcagtttacagcgtcagggcagtttacagaggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439534 - DNA, 5620 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggtagttttccagctccttccagggcgtgtcattcagtgagccgtgttaggatagaccagggctcttaagtgtcccagaggagcctgtgagccttcataggggattaaagtaaatgaaaccacaattaactaaccaaagtagttagttttgttttccattaaactagcgggaaatgaactgttgagatgactgcagtgagcgtgttttgtgtggcgagtctgtgtgggaccccgctcttacctaacgcaggtaaacctggggagttgggattgggacagcctggcacctgaaccagaggaagtaagctctgccacgagggcttcatgtgcagtcaggaatctgggcaagaaggaactaaaagtggcttttctcagtttgccttaactgtggctctctgtgccgagtggtgccattcatccttttgttcagtgacgaaaactgaattccatttaactgattggcagcagggttggtgactggttggtttttgggttttggtttgtttgtttgtttatcacatcctgtttggtggccagtgtaaataccatcaaaagaaaaactggccaatcacagcactgtgggaggccgaggtgggaggataactggaccacaggagtctgagacaagtctgaacaacaaagtgagaccctagctctacaaaaaataaattatctgggcatgatggtacatgccttgtcatcctaactatgtgggagtctgaggcaggaggattgcttgagcccatgaggttgaggttgcagtgagctgtgaccgcgtcaccgcattgcagcctgaatgacagagcaagaccctgtctaaaaagtaaacttccagggtgttgtttgttgcttgtgtttgatttcagatttgagggataccctgagttaaacatgtgcctccttcccacaggcgtgtgtacatttcttatctggatagtattcatttcttccggccacgttgcctccgcacagccgtttaccatgagatccttattggatatttagagtatgtgaagaaattagggtgagtttggattaaattatttggaactagtaagaaccctttattttttactgtatgtttattccgtgaaataatgggtattttaagttttatgcgtttttatttttccatcctaagatcaattcagaatctccaaagctcctctttccaggtgctccccgagcctcacaggtctggctcctgggcacgtagcaagctctttcccatctaatcc

SEQ ID NO: 439535 - DNA, 5224 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggtagttttccagctccttccagggcgtgtcattcagtgagccgtgttaggatagaccagggctcttaagtgtcccagaggagcctgtgagccttcataggggattaaagtaaatgaaaccacaattaactaaccaaagtagttagttttgttttccattaaactagcgggaaatgaactgttgagatgactgcagtgagcgtgttttgtgtggcgagtctgtgtgggaccccgctcttacctaacgcaggtaaacctggggagttgggattgggacagcctggcacctgaaccagaggaagtaagctctgccacgagggcttcatgtgcagtcaggaatctgggcaagaaggaactaaaagtggcttttctcagtttgccttaactgtggctctctgtgccgagtggtgccattcatccttttgttcagtgacgaaaactgaattccatttaactgattggcagcagggttggtgactggttggtttttgggttttggtttgtttgtttgtttatcacatcctgtttggtggccagtgtaaataccatcaaaagaaaaactggccaatcacagcactgtgggaggccgaggtgggaggataactggaccacaggagtctgagacaagtctgaacaacaaagtgagaccctagctctacaaaaaataaattatctgggcatgatggtacatgccttgtcatcctaactatgtgggagtctgaggcaggaggattgcttgagcccatgaggttgaggttgcagtgagctgtgaccgcgtcaccgcattgcagcctgaatgacagagcaagacctccatctcaaaaaaagaaaaaagaaagaaa

SEQ ID NO: 439536 - DNA, 3840 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaaggtacagttttaagtttttccggaaagtgaattttcctggttaatccagccagaggggtgttatactaatatgagaccacgcctgtatactgggagtgcatatgtgcaatctgctgcctggtgacacag

SEQ ID NO: 439537 - DNA, 2222 bp, Homo sapiens
cacaaacgcacagcacacacacgcacacacatgcatacacagcacacaaacgcacggcacacacacgcacacacatgcacacacagcacacacacaaacgcacagcacacacaaacgcacagcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439538 - DNA, 2681 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacaggtactgtgccccactgggaccgtggctccctaggaaataaaattcttgtgttaagttttggttttttttttctgtcttccttcgtggaaattaaaattccagaatgcacatttca

SEQ ID NO: 439539 - DNA, 2636 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacaggtactgtgccccactgggaccgtggctccctaggaaataaaattcttgtgttaagttttggttttttttttctgtcttccttcgtggaaattaaaattccagaatgcacatttca

SEQ ID NO: 439540 - DNA, 1319 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagccactggagtgaacccccagttagccagcaaacagagcatggtcaacagtttgcccaccttccctacagatatcaagaatacttcagtcaccaacgtgccaaa

SEQ ID NO: 439541 - DNA, 1093 bp, Homo sapiens
  misc_feature (2)..(2): n is a, c, g, or t
tncttttttttttaattgaggaatcaacagccgccatcttgtcgcggacccgaccggggcttcgagcgcgatctactcggccccgccggtcccgggccccacaaccgcccgcgcaccccgctccgcccggccggcccgctccgcccggccctcggcgcccgccccggcggccccgctcgcctctcggctcggcctcccggagcccggcggcggcggcggcggcagcggcggcggcggcggcggaacggggggtgggggggccgcggcggcggcggcgaccccgctcggcgcattgtttttcctcacggcggcggcggcggcgggccgcgggccgggagcggagcccggagccccctcgtcgtcgggccgcgagcgaattcattaagtggggcgcggggggggagcgaggcggcggcggcggcggcaccatgttctcggggactgcctgagccgcccggccgggcgccgtcgctgccagccgggcccgggggggcggccgggccgccggggcgcccccaccgcggagtgtcgcgctcgggaggcgggcaggggatgagggggccgcggccggcggcggcggcggcggccgggggcgggcggtgagcgctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaa

SEQ ID NO: 439542 - DNA, 1014 bp, Homo sapiens
  misc_feature (2)..(2): n is a, c, g, or t
tncttttttttttaattgaggaatcaacagccgccatcttgtcgcggacccgaccggggcttcgagcgcgatctactcggccccgccggtcccgggccccacaaccgcccgcgcaccccgctccgcccggccggcccgctccgcccggccctcggcgcccgccccggcggccccgctcgcctctcggctcggcctcccggagcccggcggcggcggcggcggcagcggcggcggcggcggcggaacggggggtgggggggccgcggcggcggcggcgaccccgctcggcgcattgtttttcctcacggcggcggcggcggcgggccgcgggccgggagcggagcccggagccccctcgtcgtcgggccgcgagcgaattcattaagtggggcgcggggggggagcgaggcggcggcggcggcggcaccatgttctcggggactgcctgagccgcccggccgggcgccgtcgctgccagccgggcccgggggggcggccgggccgccggggcgcccccaccgcggagtgtcgcgctcgggaggcgggcaggggatgagggggccgcggccggcggcggcggcggcggccgggggcgggcggtgagcgctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagacactcctatcttaaagccagtatctcttttgcgaaaacgtgatgtgaagaattctcctcttgagccagatacatccacacctttgaaaaagaaaaagggatggcccaaaggcaagagc

SEQ ID NO: 439543 - DNA, 502 bp, Homo sapiens
ccgcaggggcctcagagtccctgctcttgatggggcagctgcttttcccatcagcagctttcctgtctcctggaagctctcatgctttctcgggtgtgtagagccttcctcaaggcagacagctgctgaccacagttgtgacgtggaatcttccgcatctggttgtggcacagtggaaacagcccccactgccctcatttgttaatttctgaactcgcactctgggtctcttttcccctttagaggcagcgtggcataaagctgataatgacaccagcctggccgaggacaggccctgctctgtcccgaaggctgcagcacctacagccacctgtagccgttcacgtatggggtctgcctggtggtgacctactttggcctgagcttcctgatgcccacggcctgggagctgggcgtccgtgccaagtgtggaggggcacttgcctggtctcacagccttgcgtgttgttgcaggggcagtcagggcgacagcaagaatgcc

SEQ ID NO: 439544 - DNA, 440 bp, Homo sapiens
gtctaatatactaacagaaataatttactagtctctatagtagactagaacattataagacagtaaatggaatgtatttttatataaaagtatttctcctttatttttgcagtatgagttttccccacagactttgtgctgctatgggaagcagctgtgtaccattcctcgcgatgctgcctactacagctatcagaataggtaagcgtcaagcagcatcctgcattatgtcttagggcaaggcacgttcatctggttatagtctgtgtacattatttctttcctgaagttccaataaaaagtggcccaatttcaggccgggtgtggtggctcacgcctgtaatcccagcactttgggaggctgaggtgggagaatcacttgagcccaggagttatgttatcagccttggcgacatagagaaacccccatctctatttga

SEQ ID NO: 439545 - DNA, 439 bp, Homo sapiens
ctgtgcgttccatcttattttacttaagagtttatttagcaagttgtaattctgttttcctgtgggtgcttttcctaatgaaccgttgtgggtacatttacagggatgaattcatttaaccccatgtccttggggaacgtccagttgccacaagcacccatgggacctcgtgcagcctccccaatgaaccactctgtccagatgaacagcatgggctcagtgccaggggtaagtgttctctttcgctgtgctgcagatagccctccctctcacatggaacattatctaagcagcagaattcatgtcacttgagaatcctgtggttcttgttcctttgaatttgggttatgctttatttctttcatctctcattttaaaaaaattattactacacagaattatttgactgttagttattttattggaataacaaattcat

SEQ ID NO: 439546 - DNA, 10198 bp, Homo sapiens
  misc_feature (2)..(2): n is a, c, g, or t
tncttttttttttaattgaggaatcaacagccgccatcttgtcgcggacccgaccggggcttcgagcgcgatctactcggccccgccggtcccgggccccacaaccgcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439547 - DNA, 10087 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439548 - DNA, 9973 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439549 - DNA, 9036 bp, Homo sapiens
  misc_feature (2)..(2): n is a, c, g, or t
tncttttttttttaattgaggaatcaacagccgccatcttgtcgcggacccgaccggggcttcgagcgcgatctactcggccccgccggtcccgggccccacaaccgcccgcgcaccccgctccgcccggccggcccgctccgcccggccctcggcgcccgccccggcggccccgctcgcctctcggctcggcctcccggagcccggcggcggcggcggcggcagcggcggcggcggcggcggaacggggggtgggggggccgcggcggcggcggcgaccccgctcggcgcattgtttttcctcacggcggcggcggcggcgggccgcgggccgggagcggagcccggagccccctcgtcgtcgggccgcgagcgaattcattaagtggggcgcggggggggagcgaggcggcggcggcggcggcaccatgttctcggggactgcctgagccgcccggccgggcgccgtcgctgccagccgggcccgggggggcggccgggccgccggggcgcccccaccgcggagtgtcgcgctcgggaggcgggcaggggatgagggggccgcggccggcggcggcggcggcggccgggggcgggcggtgagcgctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagac

SEQ ID NO: 439550 - DNA, 7879 bp, Homo sapiens
tctgttttcctgtgggtgcttttcctaatgaaccgttgtgggtacatttacagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439551 - DNA, 8904 bp, Homo sapiens
  misc_feature (2)..(2): n is a, c, g, or t
tncttttttttttaattgaggaatcaacagccgccatcttgtcgcggacccgaccggggcttcgagcgcgatctactcggccccgccggtcccgggccccacaaccgcccgcgcaccccgctccgcccggccggcccgctccgcccggccctcggcgcccgccccggcggccccgctcgcctctcggctcggcctcccggagcccggcggcggcggcggcggcagcggcggcggcggcggcggaacggggggtgggggggccgcggcggcggcggcgaccccgctcggcgcattgtttttcctcacggcggcggcggcggcgggccgcgggccgggagcggagcccggagccccctcgtcgtcgggccgcgagcgaattcattaagtggggcgcggggggggagcgaggcggcggcggcggcggcaccatgttctcggggactgcctgagccgcccggccgggcgccgtcgctgccagccgggcccgggggggcggccgggccgccggggcgcccccaccgcggagtgtcgcgctcgggaggcgggcaggggatgagggggccgcggccggcggcggcggcggcggccgggggcgggcggtgagcgctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaagaaggcttcttctctagtaacattagcatggtctaagagtgatcaccctattttttgtctaaaaccagtttatacaggtaccgagctcgattgt

SEQ ID NO: 439552 - DNA, 7085 bp, Homo sapiens
ctttatttcttcttccggaagagaagaggaatcataaatgcaactctgactagaggaaggttttaacaaacctgttttaggcttgtaagagtcttcccgtgaggttgcggtaacataaaggtgtttgatattcatatgttatctgtaatgtttttctcaagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439553 - DNA, 6045 bp, Homo sapiens
ctgccccattcccttctgaaacttgaaaaggataggggcatttgatcaaagtgtcttgaacagaatgaatgaggtttatgttgacattgacccttggagaaaaatagtcaaccgaactgcctttacagtgcacaggaggaaggggatggcattgccttgatgagccatcatattccctggttctttaatgaggcctcaggtttcttttgcagcctcggccctgccctgtgtgtgcaccccaagggagaagtgttgcagggctaatttgcaggcttgcatttgctcaggataaagttcgagccttgcccccaccacacccagctttgtgggcattcattctctctctctggttacttctgtcctggctttagtccttgctcctctgctataactccttaaaggcagggccgatttcactggcacgttcatctgacgtgtgtgcgtgggtcctgcaggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439554 - DNA, 4685 bp, Homo sapiens
cttggggaagagggagaactggctgtctgagtggtggctcaagaccgcctacctgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaaattggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccgggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaaaat

SEQ ID NO: 439555 - DNA, 4544 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggtacccggcgctgaaggaaggtggtggcttttgtcacaactgaggggaggatatttgtgtgcctttttcttgcattcgcatacttgttaattaccttcacttatgaggattagaaagcagaaaaataaaagcctaaagtgag

SEQ ID NO: 439556 - DNA, 3715 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagctcaatatccaagggactgcatgacagggtcaatttcctgctcaaagacctctgcaagcttactggtcgacg

SEQ ID NO: 439557 - DNA, 3177 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccggtaagcctctctgtctctgctgtttttgggccaagactcttagaagataattttcccataaaaattgtgtgtcaggccaggcgcggtggttcacacctataatttcagcaccttgggaggccaaggtgggagaatcacttgagcccatgagttcaagaccatcctgggcaacatagtgagacctcgtctccagc

SEQ ID NO: 439558 - DNA, 2297 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaagtaaggattttatttcctactgccatcccttagcctgtttccttggttttccttcgtgttggggtgtatttctaagaacag

SEQ ID NO: 439559 - DNA, 935 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacaggtactgtgccccactgggaccgtggctccctaggaaataaaattcttgtgttaagttttggttttttttttctgtcttccttcgtggaaattaaaattccagaatgcacatttca

SEQ ID NO: 439560 - DNA, 1659 bp, Homo sapiens
gaggccaatgccaagattagaacccacatttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaaggtaagtgaactgaagcactttcaatacttcctacctaaccgcgggctttccctccgagtaatgcgtaaaatgggaccacgtggcccactcctgtttttcctcttgggctctccacgtgccactcatgcttggaagagacagatttctttctaggataaagatctctgccccatttctgtctttaaaatgagaattcttaaagaagtagggacagcttgcaggtcaggcagttggaaagtacagggcctaatgtgtccgtgaacctggtagaggttgctttctgcctgtgtactgcccactgaggaggtgatcactggtctgtatgctcctctgtggccatccagtgaagtatctgttggcacagtatccatttcactgaatgagaaagctgtgttccagggttgtcagctcactccctgctatgttaacaaggaagaggtggcagagccggggagaagcacaggcattcgggtcccagaggaaacaccagtgcagtggttcttcaagtggggtcccctggaccagcagcagcagcagcatcccctagaagcttgttagaaatgcagacttctttattgactcagaagctcggcgtggggcctgggctttaagaagcctccagatgggtgctggacacagtgactcacgcctgtgatcccagcactttgggaggccaaggtgggtggatagctcaactctaggagtttgagaccagcctgggcaatgtggcgaaaccctgtctcttggaaaaaaaaaaa

SEQ ID NO: 439561 - DNA, 657 bp, Homo sapiens
ctaacttcattttttgtttttatattgtttgtctgtctcccatgctagcatgtagggtattgatttttgtctctttggttcattgctacattattggcacctagaatagtatctgagatgtatgtactcaaatatctaaattaaggtaaaataatatgaaaacttttcatatagtaacaatatcaaaatggtctaaattgtgatgataatttacttccttctattataataaacgtaccctaactaggaatttgaaggagaaataaggatcttctacatggaatcaaaattaacttcatctattcccattttaaacaatgggaaaagatagttaaaaaaaaacaaggaagatctttaaaaacatgaatttattttgatacaacactaaaattttaattttgatgtgtctttattcctaggtttactgtttatgcaaagatagataagtacattcttaaaattattaaaatggaactctaataagttcattcctttttttacatggttgcctggtttgaaaaatccaaggacattattcagagtcaaggaaattcaaaagatgaagctgttctaaatatgatagaagacttagttgatcttctgctggtaaaaatcacattgattacactgatatttataaagcatgtgtttatttaa

SEQ ID NO: 439562 - DNA, 800 bp, Homo sapiens
  misc_feature (702)..(702): n is a, c, g, or t
  misc_feature (705)..(705): n is a, c, g, or t
  misc_feature (715)..(715): n is a, c, g, or t
  misc_feature (717)..(717): n is a, c, g, or t
  misc_feature (730)..(730): n is a, c, g, or t
  misc_feature (732)..(732): n is a, c, g, or t
  misc_feature (736)..(736): n is a, c, g, or t
  misc_feature (739)..(739): n is a, c, g, or t
agcggtgcagagttcgcggcgagggtggctcgcgcaggcgcgaggctccccatcagcacctgcctggccagcctcggcctcggggatgggaaatgggcgctcggagccgcccccgcgcgtgggcgactcggtcaagatacacaatcatcatcttactagttctctgtgttgctcgctaaccagtcccccagttcagtagactggagcccagagcctgcttacttgtcaggtgtttattttgtcttgctttttttttttttttaaatgaagtcaaaatgccaataagaccagatctccagcagttggaaaaatgcattgatgatgctttaagaaaaaatgatttcaaacctttgaaaacacttttgcaaattgatatttgtgaagatgtgaagattaaatgcagcaaacagtttttccacaaggtggacaaccttatatgcagggaacttaataaagaggatatccacaatgtttcagccattttggtttctgttggaagatgtggcaaaaatatcagtgtattggggcaagctggacttctaacgatgataaaacaaggactaatacaaaagatggttgcctggtttgaaaaatccaaggacattattcagagtcaaggaaattcaaaagatgaagctgttctaaatatgatagaagacttagttgatcttctgctgggtcatacatgatgtcagggatganggntacaaaccantnttgggaaagtttngnaccncgncattggttcccgtggttattggactccaggagtgacattttggtattacagcagaaatttc

SEQ ID NO: 439563 - DNA, 5552 bp, Homo sapiens
  misc_feature (4546)..(4546): n is a, c, g, or t
ctaacttcattttttgtttttatattgtttgtctgtctcccatgctagcatgtagggtattgatttttgtctctttggttcattgctacattattggcacctagaatagtatctgagatgtatgtactcaaatatctaaattaaggtaaaataatatgaaaacttttcatatagtaacaatatcaaaatggtctaaattgtgatgataatttacttccttctattataataaacgtaccctaactaggaatttgaaggagaaataaggatcttctacatggaatcaaaattaacttcatctattcccattttaaacaatgggaaaagatagttaaaaaaaaacaaggaagatctttaaaaacatgaatttattttgatacaacactaaaattttaattttgatgtgtctttattcctaggtttactgtttatgcaaagatagataagtacattcttaaaattattaaaatggaactctaataagttcattcctttttttacatggttgcctggtttgaaaaatccaaggacattattcagagtcaaggaaattcaaaagatgaagctgttctaaatatgatagaagacttagttgatcttctgctggtcatacatgatgtcagtgatgaaggtaaaaaacaagtagtggaaagtttcgtacctcgcatttgttccctggttattgactcaagagtgaatatttgtattcagcaagagattataaaaaaaatgaatgctatgcttgacaaaatgcctcaagatgcccggaaaatactctctaaccaagaaatgttaattctcatgagtagtatgggagaaaggattttagatgctggagattatgacttacaggtagccattgtagaagctttgtgtagaatgaccacagaaaaacaaagacaagaactggcacatcagtggttttcaatggattttattgctaaggcatttaaaagaattaaggactctgaatttgaaacagattgcaggatatttctcaaccttgtaaatggcatgcttggagacaaaagaagggtctttacatttccttgtttatcagcatttcttgataaatatgagctgcaaataccatcagatgaaaaacttgaggaattttggattgattttaatcttgggagtcagactctctcattctacattgctggagataatgatgatcatcaatgggaagcagttactgtgccagaggaaaaagtacaaatatacagcattgaagtgtgagaatcaaagaagctactgacaataattctgaaaaatacagtaaaaattagcaaaagagaagggaaagaattgcttttgtattttgacgcatcactagaaatcactaatgtaactcaaaaaatttttggtgcaactaaacatagggaatctatcagaaaacaaggtatttcagttgccaaaacgtcgctgcatatactttttgacgcaagtggatcacagattctagtgccagaaagtcaaatctcaccagtcggagaagagctcgttagtttaaaggaaaaatcaaagtccccaaaggaatttgctaaaccttcaaaatatatcaaaaacagtgacaaagggaatagaaataatagtcagcttgagaaaactactcctagcaaaagaaaaatgtctgaagcatcaatgattgtttctggtgcagatagatacactatgagaagtccagtgcttttcagcaacacatcaataccaccacgaagaagaagaattaaaccaccactgcaaatgacgagctctgcagagaaacctagtgtttctcaaacatcagaaaatagagtggataatgctgcatcactgaaatctagatcatcagaaggaagacatagaagagataatatagacaaacatatcaaaactgctaagtgtgtagaaaacacagaaaataagaatgttgaattcccaaaccaaaattttagtgaactccaggatgttataccagattcacaggcagcggaaaaaagagatcatactatattacctggtgttttagacaacatctgtggaaataaaatacacagcaaatgggcatgttggacacctgtaacaaacattgaactatgtaataaccaaagagcaagtacttcgtcaggagacacattgaatcaagatattgttataaataaaaaacttactaaacaaaaatcatcctcttcaatatctgatcataattctgaaggaacaggaaaagtgaaatataagaaagaacaaaccgaccatatcaaaatagataaagcagaagtagaagtttgcaagaaacacaatcagcaacaaaatcatcctaaatattcagggcagaaaaatactgaaaatgccaagcagagtgattggcctgttgaatctgaaactacttttaaatcggttctcctaaataagacaattgaagaatcgctgatatataggaagaaatacatattgtcaaaagatgtgaatactgctacttgcgataaaaatccatctgctagcaaaaatgtgcaaagtcatagaaaagcagagaaagaattgacttctgagcttaattcctgggattcgaaacaaaaaaaaatgagagaaaagtcaaaagggaaagaatttaccaatgtagcagaatccttgataagccaaatcaataaaagatacaaaacaaaagatgacatcaagtctacaagaaaattaaaggagtctttgattaacagtggtttttcaaacaaacctgttgtacaactcagtaaggaaaaagttcagaaaaaaagctacagaaaactgaagactacctttgttaatgttacttctgaatgcccagtgaatgatgtttacaattttaatttgaatggagctgatgaccctatcataaaacttggaatccaagagtttcaagctacagctaaagaagcttgtgcggataggtcaattagattggtaggtccaaggaatcatgatgaacttaaatcttctgtcaaaacaaaagataaaaaaattataacaaatcatcaaaagaaaaatctgtttagtgatactgaaacagagtacagatgtgatgacagcaagactgatattagctggctaagagaaccgaaatcaaaaccacagctaatagactatagcagaaataaaaatgtgaagaatcataaaagtggaaaatcaagatcatccttggaaaagggacagccaagctctaaaatgacacccagtaaaaatatcacaaaaaagatggacaagacaattccggaaggaagaatcagacttccacgaaaagcaaccaaaacaaaaaaaaactataaagatctctcaaattcagaatcagagtgtgaacaagaattttcacattcatttaaagagaacataccagtaaaggaggagaatatccattccagaatgaaaacggtaaagctaccaaagaaacaacagaaagtcttctgtgctgaaacagaaaaggaactatcaaaacaatggaaaaactcatctctactaaaagatgctatacgagataattgccttgacttatctcccagatctttatctggcagtccatcatctatagaagtaacgagatgtatagagaaaataacagaaaaggattttactcaggattatgactgcataacaaaatctatatcaccttatccaaaaacttcatcacttgaatccttaaatagtaacagtggagttggaggtacaataaagtcacccaaaaacaatgagaaaaacttcctgtgtgcaagtgaaagttgttcaccaactccacgaccactgtttttggccagacatactccaactaagagtaatactattgtaaatagaaaaaaaataagttctctggtacttacacaagaaacacaaaacagtaacagctattcagatgtaagcagatatagttcagaagaacggtttatggaaattgaatctccacatatcaatgaaaattatatacaaagcaaaagagaggaaagtcatttagcatcttcattatccaagtctagtgaaggaagagagaaaacgtggtttgacatgccctgtgatgctactcatgtatcaggccccacccaacatcttagtcgcaaaagaatatatatagaagataatctaagtaattccaatgaagtagaaatggaagagaaaggagaaaggagagcaaacttgcttcccaaaaaactgtgtaaaattgaagatgcagatcatcatatccacaaaatgtctgaaagtgtatcttcattatcaacaaatgacttttctattccttgggagacctggcaaaatgaatttgcagggatagagatgacttatgagacttacgagaggctcaattcagaatttaagagaaggaataatatccgacataaaatgttgagttattttactacgcagtcttggaaaacagctcagcaacatctgagaacaatgaatcatcaaagtcaggactctaggattaaaaaacttgataaattccaattcattatcatagaggagctggagaattttgaaaaagattcacagtctttaaaagatttggaaaaggaatttgtggacttttgggaaaagatatttncagaaagttcagtgcattatcaaaaaagcgaacaacagaggcttcatcttttgaaaacttcattggctaaaagtgtcttctgtaatactgatagtgaagaaactgtttttacatccgagatgtgtttgatgaaagaagatatgaaagtgctgcaagacaggcttcttaaggacatgctagaagaggagcttcttaatgtacgcagagaactgatgtcagtattcatgtctcatgaaagaaatgctaatgtgtgaaatctagtttttatcaccatactttatctaattattattctctgtatataactgaggaaataagaatagtcctacaaagagaaaaatatacatgtcaccgaagcaagtgtaccctttataggaaccctcaaattaaaaaaaaatgtcttttaatggatgagagggaaccactataacatgagtccaagcccagaagacttctgtctatacaatatttttttttaattttggagataaaagctttaagaaactttttgagttaattatactcataaaatgagtttctttaataaattaaattttattgtgtaaaatgtattattacataaaatgtgtttttgaatcaatgcagtttggggatgaatataattaaaatatgtttaataacttagaattcaactaataaaaatttagccacacttacaagggggaggaagtccctagtttaaaatgtataactgagtggtagatcagtactttcagcacactgttggaaacatttattcagatatggctctaatgtattaggaagcactaaatggcctaaaaaagctactacattgcctaaatatgttaattcaatatagaagtcctatttcataaccaggctgtttgacaaatacttttaatctagtagtcattgtaatatcttgctagattaatttataaaaatgagtatacatttgatttgcttttaatgaagttgaaataaatgcttatgtcacttgaataaatataaatcattatattcc

SEQ ID NO: 439564 - DNA, 4847 bp, Homo sapiens
  misc_feature (3841)..(3841): n is a, c, g, or t
ctctgtttactggattggtaagttcattgaggccaagtgctagatccttctcacctcacaatctcctgacacttaatttttgtcaaatgttgtttattgtcagcatgttataacaactgtggatttaatagaaatgtttatatgtgtatgtctagaaatatggtaattatatggaattaaagttattgtttttgtttgcctttttttaaattaagaaaatagtattctcagatgtgttcaaggaatattttattaagaatttgttagagtccagaatgtatttaggattctatcttattagttatagccatatcctgtattttatagataagaacactgagactaggaaagctaaattgacttgattgatttacataggtaagtagtgccagaattgattaatttaaacactgttcaatattgagaatttgaattttgattcaattaatctgctacatccatgtcttatttatagtatacttgcagagtagtatcatagaaacgtaaactaatcagtgttgtttctatacagtgtgagaatcaaagaagctactgacaataattctgaaaaatacagtaaaaattagcaaaagagaagggaaagaattgcttttgtattttgacgcatcactagaaatcactaatgtaactcaaaaaatttttggtgcaactaaacatagggaatctatcagaaaacaaggtatttcagttgccaaaacgtcgctgcatatactttttgacgcaagtggatcacagattctagtgccagaaagtcaaatctcaccagtcggagaagagctcgttagtttaaaggaaaaatcaaagtccccaaaggaatttgctaaaccttcaaaatatatcaaaaacagtgacaaagggaatagaaataatagtcagcttgagaaaactactcctagcaaaagaaaaatgtctgaagcatcaatgattgtttctggtgcagatagatacactatgagaagtccagtgcttttcagcaacacatcaataccaccacgaagaagaagaattaaaccaccactgcaaatgacgagctctgcagagaaacctagtgtttctcaaacatcagaaaatagagtggataatgctgcatcactgaaatctagatcatcagaaggaagacatagaagagataatatagacaaacatatcaaaactgctaagtgtgtagaaaacacagaaaataagaatgttgaattcccaaaccaaaattttagtgaactccaggatgttataccagattcacaggcagcggaaaaaagagatcatactatattacctggtgttttagacaacatctgtggaaataaaatacacagcaaatgggcatgttggacacctgtaacaaacattgaactatgtaataaccaaagagcaagtacttcgtcaggagacacattgaatcaagatattgttataaataaaaaacttactaaacaaaaatcatcctcttcaatatctgatcataattctgaaggaacaggaaaagtgaaatataagaaagaacaaaccgaccatatcaaaatagataaagcagaagtagaagtttgcaagaaacacaatcagcaacaaaatcatcctaaatattcagggcagaaaaatactgaaaatgccaagcagagtgattggcctgttgaatctgaaactacttttaaatcggttctcctaaataagacaattgaagaatcgctgatatataggaagaaatacatattgtcaaaagatgtgaatactgctacttgcgataaaaatccatctgctagcaaaaatgtgcaaagtcatagaaaagcagagaaagaattgacttctgagcttaattcctgggattcgaaacaaaaaaaaatgagagaaaagtcaaaagggaaagaatttaccaatgtagcagaatccttgataagccaaatcaataaaagatacaaaacaaaagatgacatcaagtctacaagaaaattaaaggagtctttgattaacagtggtttttcaaacaaacctgttgtacaactcagtaaggaaaaagttcagaaaaaaagctacagaaaactgaagactacctttgttaatgttacttctgaatgcccagtgaatgatgtttacaattttaatttgaatggagctgatgaccctatcataaaacttggaatccaagagtttcaagctacagctaaagaagcttgtgcggataggtcaattagattggtaggtccaaggaatcatgatgaacttaaatcttctgtcaaaacaaaagataaaaaaattataacaaatcatcaaaagaaaaatctgtttagtgatactgaaacagagtacagatgtgatgacagcaagactgatattagctggctaagagaaccgaaatcaaaaccacagctaatagactatagcagaaataaaaatgtgaagaatcataaaagtggaaaatcaagatcatccttggaaaagggacagccaagctctaaaatgacacccagtaaaaatatcacaaaaaagatggacaagacaattccggaaggaagaatcagacttccacgaaaagcaaccaaaacaaaaaaaaactataaagatctctcaaattcagaatcagagtgtgaacaagaattttcacattcatttaaagagaacataccagtaaaggaggagaatatccattccagaatgaaaacggtaaagctaccaaagaaacaacagaaagtcttctgtgctgaaacagaaaaggaactatcaaaacaatggaaaaactcatctctactaaaagatgctatacgagataattgccttgacttatctcccagatctttatctggcagtccatcatctatagaagtaacgagatgtatagagaaaataacagaaaaggattttactcaggattatgactgcataacaaaatctatatcaccttatccaaaaacttcatcacttgaatccttaaatagtaacagtggagttggaggtacaataaagtcacccaaaaacaatgagaaaaacttcctgtgtgcaagtgaaagttgttcaccaactccacgaccactgtttttggccagacatactccaactaagagtaatactattgtaaatagaaaaaaaataagttctctggtacttacacaagaaacacaaaacagtaacagctattcagatgtaagcagatatagttcagaagaacggtttatggaaattgaatctccacatatcaatgaaaattatatacaaagcaaaagagaggaaagtcatttagcatcttcattatccaagtctagtgaaggaagagagaaaacgtggtttgacatgccctgtgatgctactcatgtatcaggccccacccaacatcttagtcgcaaaagaatatatatagaagataatctaagtaattccaatgaagtagaaatggaagagaaaggagaaaggagagcaaacttgcttcccaaaaaactgtgtaaaattgaagatgcagatcatcatatccacaaaatgtctgaaagtgtatcttcattatcaacaaatgacttttctattccttgggagacctggcaaaatgaatttgcagggatagagatgacttatgagacttacgagaggctcaattcagaatttaagagaaggaataatatccgacataaaatgttgagttattttactacgcagtcttggaaaacagctcagcaacatctgagaacaatgaatcatcaaagtcaggactctaggattaaaaaacttgataaattccaattcattatcatagaggagctggagaattttgaaaaagattcacagtctttaaaagatttggaaaaggaatttgtggacttttgggaaaagatatttncagaaagttcagtgcattatcaaaaaagcgaacaacagaggcttcatcttttgaaaacttcattggctaaaagtgtcttctgtaatactgatagtgaagaaactgtttttacatccgagatgtgtttgatgaaagaagatatgaaagtgctgcaagacaggcttcttaaggacatgctagaagaggagcttcttaatgtacgcagagaactgatgtcagtattcatgtctcatgaaagaaatgctaatgtgtgaaatctagtttttatcaccatactttatctaattattattctctgtatataactgaggaaataagaatagtcctacaaagagaaaaatatacatgtcaccgaagcaagtgtaccctttataggaaccctcaaattaaaaaaaaatgtcttttaatggatgagagggaaccactataacatgagtccaagcccagaagacttctgtctatacaatatttttttttaattttggagataaaagctttaagaaactttttgagttaattatactcataaaatgagtttctttaataaattaaattttattgtgtaaaatgtattattacataaaatgtgtttttgaatcaatgcagtttggggatgaatataattaaaatatgtttaataacttagaattcaactaataaaaatttagccacacttacaagggggaggaagtccctagtttaaaatgtataactgagtggtagatcagtactttcagcacactgttggaaacatttattcagatatggctctaatgtattaggaagcactaaatggcctaaaaaagctactacattgcctaaatatgttaattcaatatagaagtcctatttcataaccaggctgtttgacaaatacttttaatctagtagtcattgtaatatcttgctagattaatttataaaaatgagtatacatttgatttgcttttaatgaagttgaaataaatgcttatgtcacttgaataaatataaatcattatattcc

SEQ ID NO: 439565 - DNA, 293 bp, Homo sapiens
tattatgaccactgcctgatttccttttgattctaggcatgatttctattactggacaagattatgctgtgaaagcttatttatttttttcttaaactactttttatttcagggtctttacatttccttgtttatcagcatttcttgataaatatgaggtaaaattttaatttaacacattattttagttattgcatgaattttgatagtcaagtgaattatgagttaaaaatgaataagaacactaaaaatagttgtaattagatcatgaatgtagctggtctagtattctg

SEQ ID NO: 439566 - DNA, 5584 bp, Homo sapiens
  misc_feature (4578)..(4578): n is a, c, g, or t
aggcgctgcggcggtccctgaggcgcagagttgcgacgctcggcggcatagggggcggctccaccgacactacgcggacgcctcctgccgcaggcagatacacaatcatcatcttactagttctctgtgttgctcgctaaccagtcccccagttcagtagactggagcccagagcctgcttacttgtcaggtgtttattttgtcttgctttttttttttttttaaatgaagtcaaaatgccaataagaccagatctccagcagttggaaaaatgcattgatgatgctttaagaaaaaatgatttcaaacctttgaaaacacttttgcaaattgatatttgtgaagatgtgaagattaaatgcagcaaacagtttttccacaaggtggacaaccttatatgcagggaacttaataaagaggatatccacaatgtttcagccattttggtttctgttggaagatgtggcaaaaatatcagtgtattggggcaagctggacttctaacgatgataaaacaaggactaatacaaaagatggttgcctggtttgaaaaatccaaggacattattcagagtcaaggaaattcaaaagatgaagctgttctaaatatgatagaagacttagttgatcttctgctggtcatacatgatgtcagtgatgaaggtaaaaaacaagtagtggaaagtttcgtacctcgcatttgttccctggttattgactcaagagtgaatatttgtattcagcaagagattataaaaaaaatgaatgctatgcttgacaaaatgcctcaagatgcccggaaaatactctctaaccaagaaatgttaattctcatgagtagtatgggagaaaggattttagatgctggagattatgacttacaggtagccattgtagaagctttgtgtagaatgaccacagaaaaacaaagacaagaactggcacatcagtggttttcaatggattttattgctaaggcatttaaaagaattaaggactctgaatttgaaacagattgcaggatatttctcaaccttgtaaatggcatgcttggagacaaaagaagggtctttacatttccttgtttatcagcatttcttgataaatatgagctgcaaataccatcagatgaaaaacttgaggaattttggattgattttaatcttgggagtcagactctctcattctacattgctggagataatgatgatcatcaatgggaagcagttactgtgccagaggaaaaagtacaaatatacagcattgaagtgtgagaatcaaagaagctactgacaataattctgaaaaatacagtaaaaattagcaaaagagaagggaaagaattgcttttgtattttgacgcatcactagaaatcactaatgtaactcaaaaaatttttggtgcaactaaacatagggaatctatcagaaaacaaggtatttcagttgccaaaacgtcgctgcatatactttttgacgcaagtggatcacagattctagtgccagaaagtcaaatctcaccagtcggagaagagctcgttagtttaaaggaaaaatcaaagtccccaaaggaatttgctaaaccttcaaaatatatcaaaaacagtgacaaagggaatagaaataatagtcagcttgagaaaactactcctagcaaaagaaaaatgtctgaagcatcaatgattgtttctggtgcagatagatacactatgagaagtccagtgcttttcagcaacacatcaataccaccacgaagaagaagaattaaaccaccactgcaaatgacgagctctgcagagaaacctagtgtttctcaaacatcagaaaatagagtggataatgctgcatcactgaaatctagatcatcagaaggaagacatagaagagataatatagacaaacatatcaaaactgctaagtgtgtagaaaacacagaaaataagaatgttgaattcccaaaccaaaattttagtgaactccaggatgttataccagattcacaggcagcggaaaaaagagatcatactatattacctggtgttttagacaacatctgtggaaataaaatacacagcaaatgggcatgttggacacctgtaacaaacattgaactatgtaataaccaaagagcaagtacttcgtcaggagacacattgaatcaagatattgttataaataaaaaacttactaaacaaaaatcatcctcttcaatatctgatcataattctgaaggaacaggaaaagtgaaatataagaaagaacaaaccgaccatatcaaaatagataaagcagaagtagaagtttgcaagaaacacaatcagcaacaaaatcatcctaaatattcagggcagaaaaatactgaaaatgccaagcagagtgattggcctgttgaatctgaaactacttttaaatcggttctcctaaataagacaattgaagaatcgctgatatataggaagaaatacatattgtcaaaagatgtgaatactgctacttgcgataaaaatccatctgctagcaaaaatgtgcaaagtcatagaaaagcagagaaagaattgacttctgagcttaattcctgggattcgaaacaaaaaaaaatgagagaaaagtcaaaagggaaagaatttaccaatgtagcagaatccttgataagccaaatcaataaaagatacaaaacaaaagatgacatcaagtctacaagaaaattaaaggagtctttgattaacagtggtttttcaaacaaacctgttgtacaactcagtaaggaaaaagttcagaaaaaaagctacagaaaactgaagactacctttgttaatgttacttctgaatgcccagtgaatgatgtttacaattttaatttgaatggagctgatgaccctatcataaaacttggaatccaagagtttcaagctacagctaaagaagcttgtgcggataggtcaattagattggtaggtccaaggaatcatgatgaacttaaatcttctgtcaaaacaaaagataaaaaaattataacaaatcatcaaaagaaaaatctgtttagtgatactgaaacagagtacagatgtgatgacagcaagactgatattagctggctaagagaaccgaaatcaaaaccacagctaatagactatagcagaaataaaaatgtgaagaatcataaaagtggaaaatcaagatcatccttggaaaagggacagccaagctctaaaatgacacccagtaaaaatatcacaaaaaagatggacaagacaattccggaaggaagaatcagacttccacgaaaagcaaccaaaacaaaaaaaaactataaagatctctcaaattcagaatcagagtgtgaacaagaattttcacattcatttaaagagaacataccagtaaaggaggagaatatccattccagaatgaaaacggtaaagctaccaaagaaacaacagaaagtcttctgtgctgaaacagaaaaggaactatcaaaacaatggaaaaactcatctctactaaaagatgctatacgagataattgccttgacttatctcccagatctttatctggcagtccatcatctatagaagtaacgagatgtatagagaaaataacagaaaaggattttactcaggattatgactgcataacaaaatctatatcaccttatccaaaaacttcatcacttgaatccttaaatagtaacagtggagttggaggtacaataaagtcacccaaaaacaatgagaaaaacttcctgtgtgcaagtgaaagttgttcaccaactccacgaccactgtttttggccagacatactccaactaagagtaatactattgtaaatagaaaaaaaataagttctctggtacttacacaagaaacacaaaacagtaacagctattcagatgtaagcagatatagttcagaagaacggtttatggaaattgaatctccacatatcaatgaaaattatatacaaagcaaaagagaggaaagtcatttagcatcttcattatccaagtctagtgaaggaagagagaaaacgtggtttgacatgccctgtgatgctactcatgtatcaggccccacccaacatcttagtcgcaaaagaatatatatagaagataatctaagtaattccaatgaagtagaaatggaagagaaaggagaaaggagagcaaacttgcttcccaaaaaactgtgtaaaattgaagatgcagatcatcatatccacaaaatgtctgaaagtgtatcttcattatcaacaaatgacttttctattccttgggagacctggcaaaatgaatttgcagggatagagatgacttatgagacttacgagaggctcaattcagaatttaagagaaggaataatatccgacataaaatgttgagttattttactacgcagtcttggaaaacagctcagcaacatctgagaacaatgaatcatcaaagtcaggactctaggattaaaaaacttgataaattccaattcattatcatagaggagctggagaattttgaaaaagattcacagtctttaaaagatttggaaaaggaatttgtggacttttgggaaaagatatttncagaaagttcagtgcattatcaaaaaagcgaacaacagaggcttcatcttttgaaaacttcattggctaaaagtgtcttctgtaatactgatagtgaagaaactgtttttacatccgagatgtgtttgatgaaagaagatatgaaagtgctgcaagacaggcttcttaaggacatgctagaagaggagcttcttaatgtacgcagagaactgatgtcagtattcatgtctcatgaaagaaatgctaatgtgtgaaatctagtttttatcaccatactttatctaattattattctctgtatataactgaggaaataagaatagtcctacaaagagaaaaatatacatgtcaccgaagcaagtgtaccctttataggaaccctcaaattaaaaaaaaatgtcttttaatggatgagagggaaccactataacatgagtccaagcccagaagacttctgtctatacaatatttttttttaattttggagataaaagctttaagaaactttttgagttaattatactcataaaatgagtttctttaataaattaaattttattgtgtaaaatgtattattacataaaatgtgtttttgaatcaatgcagtttggggatgaatataattaaaatatgtttaataacttagaattcaactaataaaaatttagccacacttacaagggggaggaagtccctagtttaaaatgtataactgagtggtagatcagtactttcagcacactgttggaaacatttattcagatatggctctaatgtattaggaagcactaaatggcctaaaaaagctactacattgcctaaatatgttaattcaatatagaagtcctatttcataaccaggctgtttgacaaatacttttaatctagtagtcattgtaatatcttgctagattaatttataaaaatgagtatacatttgatttgcttttaatgaagttgaaataaatgcttatgtcacttgaataaatataaatcattatattcc

SEQ ID NO: 439567 - DNA, 5142 bp, Homo sapiens
  misc_feature (4578)..(4578): n is a, c, g, or t
aggcgctgcggcggtccctgaggcgcagagttgcgacgctcggcggcatagggggcggctccaccgacactacgcggacgcctcctgccgcaggcagatacacaatcatcatcttactagttctctgtgttgctcgctaaccagtcccccagttcagtagactggagcccagagcctgcttacttgtcaggtgtttattttgtcttgctttttttttttttttaaatgaagtcaaaatgccaataagaccagatctccagcagttggaaaaatgcattgatgatgctttaagaaaaaatgatttcaaacctttgaaaacacttttgcaaattgatatttgtgaagatgtgaagattaaatgcagcaaacagtttttccacaaggtggacaaccttatatgcagggaacttaataaagaggatatccacaatgtttcagccattttggtttctgttggaagatgtggcaaaaatatcagtgtattggggcaagctggacttctaacgatgataaaacaaggactaatacaaaagatggttgcctggtttgaaaaatccaaggacattattcagagtcaaggaaattcaaaagatgaagctgttctaaatatgatagaagacttagttgatcttctgctggtcatacatgatgtcagtgatgaaggtaaaaaacaagtagtggaaagtttcgtacctcgcatttgttccctggttattgactcaagagtgaatatttgtattcagcaagagattataaaaaaaatgaatgctatgcttgacaaaatgcctcaagatgcccggaaaatactctctaaccaagaaatgttaattctcatgagtagtatgggagaaaggattttagatgctggagattatgacttacaggtagccattgtagaagctttgtgtagaatgaccacagaaaaacaaagacaagaactggcacatcagtggttttcaatggattttattgctaaggcatttaaaagaattaaggactctgaatttgaaacagattgcaggatatttctcaaccttgtaaatggcatgcttggagacaaaagaagggtctttacatttccttgtttatcagcatttcttgataaatatgagctgcaaataccatcagatgaaaaacttgaggaattttggattgattttaatcttgggagtcagactctctcattctacattgctggagataatgatgatcatcaatgggaagcagttactgtgccagaggaaaaagtacaaatatacagcattgaagtgtgagaatcaaagaagctactgacaataattctgaaaaatacagtaaaaattagcaaaagagaagggaaagaattgcttttgtattttgacgcatcactagaaatcactaatgtaactcaaaaaatttttggtgcaactaaacatagggaatctatcagaaaacaaggtatttcagttgccaaaacgtcgctgcatatactttttgacgcaagtggatcacagattctagtgccagaaagtcaaatctcaccagtcggagaagagctcgttagtttaaaggaaaaatcaaagtccccaaaggaatttgctaaaccttcaaaatatatcaaaaacagtgacaaagggaatagaaataatagtcagcttgagaaaactactcctagcaaaagaaaaatgtctgaagcatcaatgattgtttctggtgcagatagatacactatgagaagtccagtgcttttcagcaacacatcaataccaccacgaagaagaagaattaaaccaccactgcaaatgacgagctctgcagagaaacctagtgtttctcaaacatcagaaaatagagtggataatgctgcatcactgaaatctagatcatcagaaggaagacatagaagagataatatagacaaacatatcaaaactgctaagtgtgtagaaaacacagaaaataagaatgttgaattcccaaaccaaaattttagtgaactccaggatgttataccagattcacaggcagcggaaaaaagagatcatactatattacctggtgttttagacaacatctgtggaaataaaatacacagcaaatgggcatgttggacacctgtaacaaacattgaactatgtaataaccaaagagcaagtacttcgtcaggagacacattgaatcaagatattgttataaataaaaaacttactaaacaaaaatcatcctcttcaatatctgatcataattctgaaggaacaggaaaagtgaaatataagaaagaacaaaccgaccatatcaaaatagataaagcagaagtagaagtttgcaagaaacacaatcagcaacaaaatcatcctaaatattcagggcagaaaaatactgaaaatgccaagcagagtgattggcctgttgaatctgaaactacttttaaatcggttctcctaaataagacaattgaagaatcgctgatatataggaagaaatacatattgtcaaaagatgtgaatactgctacttgcgataaaaatccatctgctagcaaaaatgtgcaaagtcatagaaaagcagagaaagaattgacttctgagcttaattcctgggattcgaaacaaaaaaaaatgagagaaaagtcaaaagggaaagaatttaccaatgtagcagaatccttgataagccaaatcaataaaagatacaaaacaaaagatgacatcaagtctacaagaaaattaaaggagtctttgattaacagtggtttttcaaacaaacctgttgtacaactcagtaaggaaaaagttcagaaaaaaagctacagaaaactgaagactacctttgttaatgttacttctgaatgcccagtgaatgatgtttacaattttaatttgaatggagctgatgaccctatcataaaacttggaatccaagagtttcaagctacagctaaagaagcttgtgcggataggtcaattagattggtaggtccaaggaatcatgatgaacttaaatcttctgtcaaaacaaaagataaaaaaattataacaaatcatcaaaagaaaaatctgtttagtgatactgaaacagagtacagatgtgatgacagcaagactgatattagctggctaagagaaccgaaatcaaaaccacagctaatagactatagcagaaataaaaatgtgaagaatcataaaagtggaaaatcaagatcatccttggaaaagggacagccaagctctaaaatgacacccagtaaaaatatcacaaaaaagatggacaagacaattccggaaggaagaatcagacttccacgaaaagcaaccaaaacaaaaaaaaactataaagatctctcaaattcagaatcagagtgtgaacaagaattttcacattcatttaaagagaacataccagtaaaggaggagaatatccattccagaatgaaaacggtaaagctaccaaagaaacaacagaaagtcttctgtgctgaaacagaaaaggaactatcaaaacaatggaaaaactcatctctactaaaagatgctatacgagataattgccttgacttatctcccagatctttatctggcagtccatcatctatagaagtaacgagatgtatagagaaaataacagaaaaggattttactcaggattatgactgcataacaaaatctatatcaccttatccaaaaacttcatcacttgaatccttaaatagtaacagtggagttggaggtacaataaagtcacccaaaaacaatgagaaaaacttcctgtgtgcaagtgaaagttgttcaccaactccacgaccactgtttttggccagacatactccaactaagagtaatactattgtaaatagaaaaaaaataagttctctggtacttacacaagaaacacaaaacagtaacagctattcagatgtaagcagatatagttcagaagaacggtttatggaaattgaatctccacatatcaatgaaaattatatacaaagcaaaagagaggaaagtcatttagcatcttcattatccaagtctagtgaaggaagagagaaaacgtggtttgacatgccctgtgatgctactcatgtatcaggccccacccaacatcttagtcgcaaaagaatatatatagaagataatctaagtaattccaatgaagtagaaatggaagagaaaggagaaaggagagcaaacttgcttcccaaaaaactgtgtaaaattgaagatgcagatcatcatatccacaaaatgtctgaaagtgtatcttcattatcaacaaatgacttttctattccttgggagacctggcaaaatgaatttgcagggatagagatgacttatgagacttacgagaggctcaattcagaatttaagagaaggaataatatccgacataaaatgttgagttattttactacgcagtcttggaaaacagctcagcaacatctgagaacaatgaatcatcaaagtcaggactctaggattaaaaaacttgataaattccaattcattatcatagaggagctggagaattttgaaaaagattcacagtctttaaaagatttggaaaaggaatttgtggacttttgggaaaagatatttncagaaagttcagtgcattatcaaaaaagcgaacaacagaggcttcatcttttgaaaacttcattggctaaaagtgtcttctgtaatactgatagtgaagaaactgtttttacatccgagatgtgtttgatgaaagaagatatgaaagtgctgcaagacaggcttcttaaggacatgctagaagaggagcttcttaatgtacgcagagaactgatgtcagtattcatgtctcatgaaagaaatgctaatgtgtgaaatctagtttttatcaccatactttatctaattattattctctgtatataactgaggaaataagaatagtcctacaaagagaaaaatatacatgtcaccgaagcaagtgtaccctttataggaaccctcaaattaaaaaaaaatgtcttttaatggatgagagggaaccactataacatgagtccaagcccagaagacttctgtctatacaatatttttttttaattttggagataaaagctttaagaaactttttgagttaattatactcataaaatgagtttctttaataaattaaattttattgtgt

SEQ ID NO: 439568 - DNA, 954 bp, Homo sapiens
aggcgctgcggcggtccctgaggcgcagagttgcgacgctcggcggcatagggggcggctccaccgacactacgcggacgcctcctgccgcaggcagatacacaatcatcatcttactagttctctgtgttgctcgctaaccagtcccccagttcagtagactggagcccagagcctgcttacttgtcaggtgtttattttgtcttgctttttttttttttttaaatgaagtcaaaatgccaataagaccagatctccagcagttggaaaaatgcattgatgatgctttaagaaaaaatgatttcaaacctttgaaaacacttttgcaaattgatatttgtgaagatgtgaagattaaatgcagcaaacagtttttccacaaggtggacaaccttatatgcagggaacttaataaagaggatatccacaatgtttcagccattttggtttctgttggaagatgtggcaaaaatatcagtgtattggggcaagctggacttctaacgatgataaaacaaggactaatacaaaagatggttgcctggtttgaaaaatccaaggacattattcagagtcaaggaaattcaaaagatgaagctgttctaaatatgatagaagacttagttgatcttctgctggtcatacatgatgtcagtgatgaaggtaaaaaacaagtagtggaaagtttcgtacctcgcatttgttccctggttattgactcaagagtgaatatttgtattcagcaagagattataaaaaaaatgaatgctatgcttgacaaaatgcctcaagatgcccggaaaatactctctaaccaagaaatgttaattctcatgtaataatctgtacttatatggtttttattcttaaaatccataagaatgttttataagacagacaactatgagtttgcattaataatgaaactgataaactgttgcagctttttaatat

SEQ ID NO: 439569 - DNA, 1263 bp, Homo sapiens
gaagtgtggaagagagcgctggactggctgaagactgaactagagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaaaaaaaat

SEQ ID NO: 439570 - DNA, 376 bp, Homo sapiens
  misc_feature (22)..(22): n is a, c, g, or t
  misc_feature (33)..(33): n is a, c, g, or t
  misc_feature (36)..(37): n is a, c, g, or t
  misc_feature (39)..(39): n is a, c, g, or t
  misc_feature (41)..(41): n is a, c, g, or t
  misc_feature (46)..(46): n is a, c, g, or t
  misc_feature (185)..(185): n is a, c, g, or t
  misc_feature (203)..(203): n is a, c, g, or t
attcgcggccgggtcgactgcncaagctggagnccnncngntaatncttgaacatgatgttgccatcccaacattacctcccacttcactgaccagtgccactactgaccatctagcaccagccacaacgggaccaatgactctgactaagggagaaggctgtttcaaaaataccaagtctgatntcacctcaggatctggangaaccttcaattcaacttcatcactatactttggtggcccaccactttccactacgcagcgataaagcccgccatctccttcagttgcattgctgataaccagcattccacttggaagtttgataactctagtcgacgcggccgccaatttagtagtagaagtcgacccggga

SEQ ID NO: 439571 - DNA, 404 bp, Homo sapiens
caaacaccgcaatctcccgcaatccttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtagtgtttggagatcctctagatcag

SEQ ID NO: 439572 - DNA, 6962 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataagttgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctctgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaaaaaaaat

SEQ ID NO: 439573 - DNA, 6936 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataagttgtactacatggaaaaggggactgataaagaacaggatgttgatgtttcaagtcactcttacaccattaatgggttgaaaaaatatacagagtatagtttccgagtggtggcctacaataaacatggtcctggagtttccacacaacatacgagcacgatgatgtcagtgtctcatgttggaagtgagaaattcgaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctctgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaaaaaaaat

SEQ ID NO: 439574 - DNA, 3001 bp, Homo sapiens
gtgggttgaccgtggcttgtgggttgaccgtggcttgtgggttgaccgtggcttcatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaaaaaaaat

SEQ ID NO: 439575 - DNA, 5759 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataagttgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctctgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatctcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaaaaaaaat

SEQ ID NO: 439576 - DNA, 5082 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataagttgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctctgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctgcctgagatgggatcctctagacgcccct

SEQ ID NO: 439577 - DNA, 4475 bp, Homo sapiens
  misc_feature (4404)..(4404): n is a, c, g, or t
  misc_feature (4424)..(4424): n is a, c, g, or t
  misc_feature (4444)..(4444): n is a, c, g, or t
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataagttgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctctgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtaggtattgaaccaggtgaggttgaccaaagagttgggccatngggggagggattaattgaangggaccttaaacgttttttnacaacagcttgacggacttttaacggggggc

SEQ ID NO: 439578 - DNA, 2690 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataagttgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagtgccagatcccactcccatgatgccacctatcacaccccatcctaaaaaaaaaaa

SEQ ID NO: 439579 - DNA, 1674 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgatgttgccatcccaacattacctcccacttcactgaccagtgccactactgaccatctagcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctaggtaagtgcctgtgtgtctgcag

SEQ ID NO: 439580 - DNA, 904 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagaatggtaacacctgtgccgaa

SEQ ID NO: 439581 - DNA, 503 bp, Homo sapiens
ctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccaggtattaactcattatcaggactgatggttttatgtttatgaatgggtaaacattgttctgttagaatttttaaaaataatgaatgttggccgggcgcagtggctcacacctgtaatcccagcactttgggaggttgaagcgggtggatcacctgagttccagcctggccaacatggcgaaaccccatctctactaaaaatacaaaaattagccagacatggtggcaggcgcttataactccagctactctggaggctgaggaaggagaattacttgaacccgggaggtggagggtgcagtgagctgagattgtgccattgcactccagcctgggcgatagagcaagactccatctcaa

SEQ ID NO: 439582 - DNA, 5272 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataagttgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctctgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattg

SEQ ID NO: 439583 - DNA, 7043 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataagttgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctctgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaaaaaaaat

SEQ ID NO: 439584 - DNA, 3321 bp, Homo sapiens
ggactggtaccgccccggatttatgggctggacagcaatatccatcaaaggcgaaacttcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaaaaaaaat

SEQ ID NO: 439585 - DNA, 6844 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataagttgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctctgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgccctcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaaaaaaaat

SEQ ID NO: 439586 - DNA, 5224 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataagttgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctctgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctca

SEQ ID NO: 439587 - DNA, 3490 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataagttgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctctgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagtaagaagccccagatgcac

SEQ ID NO: 439588 - DNA, 2553 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataagttgtactacatggaaaaggggactgataaagaacaggatgttgatgtttcaagtcactcttacaccattaatgggttgaaaaaatatacagagtatagtttccgagtggtggcctacaataaacatggtcctggagtttccacacaacatacgagcacgatgatgtcagtgtctcatgttggaagtgagaaattcgaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatggtaagaataacaattggcaagactggaacacaatagatactagctgtagtcaaatgagtcaaactggaaagccacagacttggggtggatatggctcaagtctgtgaactttagtgcatcacgctgctgttgttcctgtattgcatcgaggctgctggaatggattttttgcagtgccttgtagagaactgtcctttcaagcagaactagagcaaataaaaatgtgtatgtgcta

SEQ ID NO: 439589 - DNA, 1072 bp, Homo sapiens
gggccgggccgggctgggctggagcagcggcgccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaaggtaagtgttgtctgcctaaaagccttcttcagccttagcttgagactttgtca

SEQ ID NO: 439590 - DNA, 1790 bp, Homo sapiens
  misc_feature (38)..(38): n is a, c, g, or t
  misc_feature (42)..(42): n is a, c, g, or t
  misc_feature (48)..(48): n is a, c, g, or t
aaggcaacaccacaacacgcatgacgaggcctggggtnaatnggcaangatttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggttccggtgggaatgacaacttcggtcgtggaggaaacttcagtggtccgtggtggctttggtggcagccgtggtggtggtggatatggtggcagtggggatggctataatggatttggtaatgatggaagccattttggaggtggtggaagctacaatgatttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagcaagattccaattaggaaacaaacgcttagcaggagaggagagccagagaagtgacagggaagccacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgaatttaattctcttgaaaaaaaaaaaaa

SEQ ID NO: 439591 - DNA, 1633 bp, Homo sapiens
ctttcagtgccgggctgggcttaatgctagatagctgtgacgtgggcctttcagatgcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggttccggtgggaatgacaacttcggtcgtggaggaaacttcagtggtccgtggtggctttggtggcagccgtggtggtggtggatatggtggcagtggggatggctataatggatttggtaatgatggaagccattttggaggtggtggaagctacaatgatttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagcaagattccaattaggaaacaaacgcttagcaggagaggagagccagagaagtgacagggaagccacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgaatttaattctcttgaaaaaaaaaaaaa

SEQ ID NO: 439592 - DNA, 1760 bp, Homo sapiens
  misc_feature (38)..(38): n is a, c, g, or t
  misc_feature (42)..(42): n is a, c, g, or t
  misc_feature (48)..(48): n is a, c, g, or t
aaggcaacaccacaacacgcatgacgaggcctggggtnaatnggcaangatttctgcccgtggacgccgccgaagaagcatcgttaaagtctctcttcaccctgccgtcatgtctaagtcagagtctcctaaagagcccgaacactttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggttccggtgggaatgacaacttcggtcgtggaggaaacttcagtggtccgtggtggctttggtggcagccgtggtggtggtggatatggtggcagtggggatggctataatggatttggtaatgatggaagccattttggaggtggtggaagctacaatgatttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagcaagattccaattaggaaacaaacgcttagcaggagaggagagccagagaagtgacagggaagccacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgaatttaattctcttgaaaaaaaaaaaaa

SEQ ID NO: 439593 - DNA, 802 bp, Homo sapiens
  misc_feature (38)..(38): n is a, c, g, or t
  misc_feature (42)..(42): n is a, c, g, or t
  misc_feature (48)..(48): n is a, c, g, or t
aaggcaacaccacaacacgcatgacgaggcctggggtnaatnggcaangatttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtgatcttcttcagtgtcttctttaatgccaccaacaaatatctttttcacagttaagtgggcacctggtc

SEQ ID NO: 439594 - DNA, 3972 bp, Homo sapiens
  misc_feature (541)..(541): n is a, c, g, or t
  misc_feature (810)..(810): n is a, c, g, or t
  misc_feature (825)..(825): n is a, c, g, or t
  misc_feature (901)..(901): n is a, c, g, or t
  misc_feature (909)..(909): n is a, c, g, or t
  misc_feature (1016)..(1016): n is a, c, g, or t
  misc_feature (1024)..(1024): n is a, c, g, or t
  misc_feature (1121)..(1121): n is a, c, g, or t
  misc_feature (1226)..(1226): n is a, c, g, or t
ggaaagcatccaacggagtggaagcagcatgaaggaagagccgctgggcagcggcatgaacgcggtgcggacgtggatgcagggcgccggggtgctggacgccaacacggcggcgcagagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggattcagcttctctacagcaatgggataaggacggagcaggatttctacgtgcgcctcattgactccatgacaaaacaagccatagtgtatgaaggccaagacaagagcccagaaatgtgccgagtcttgctcacacatgagatcatgtgcagccgctgttgtgacaagaaaagctgtggcaaccgaaatgagactccctcagatccagtgataattgacagnttcttcttgaaatttttcctcaaatgtaaccaaaattgcctaaagaatgcgggaaacccacgtgacatgcggagattccaggtcgtggtgtctacgacagtcaatgtggatggccatgtcctggcagctctgataacatgtttgtccataataattccaagcatgggcggagggctcggaggcttgacccctcggaaggtacgccctcttatctggaacatgctactccctgtatcaaagccatcagcccgagtgaaggatggacgacnggaggtgcgactgtnatcatcataggggacaatttctttgatgggttacaggtcatattcggtaccatgctggtctggagtgagttgacantcctcatnccatccgtgtgcagacccctcctcggcacatccctggtgttgtggaagtcacactgtcctacaaatctaagcagttctgcaaaggaacaccaggcagattcatttanacagcgcncaacgaacccaccatcgattatggtttccagaggttacagaaggtcattcctcggcaccctggtgaccctgagcgtttgccaaaggaagtaatactnaaaagggctgcggatctggtagaagcactgtatgggatgccacacaacaaccaggaaatcattctgaagagagcggccgacattgccgaggccctgtacagtgtnccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaagaaaaaaagtaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagatttttttttggtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggcttttggttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtcagtcatcactaacattctaagaaaaaagaaaaagaaaaaaagaaaaaaaaaaaaaca

SEQ ID NO: 439595 - DNA, 511 bp, Homo sapiens
cagtgagaagtttgaacgcaaagaaaccattgacttctgtcttttctttcatagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttaca

SEQ ID NO: 439596 - DNA, 2499 bp, Homo sapiens
  misc_feature (64)..(64): n is a, c, g, or t
  misc_feature (73)..(73): n is a, c, g, or t
  misc_feature (81)..(81): n is a, c, g, or t
  misc_feature (83)..(83): n is a, c, g, or t
  misc_feature (116)..(116): n is a, c, g, or t
aagtgccgcactgctcaagtcctttgccaacgccttctacctggcccagcacctgcgatcccantggggggcnaaactccncntgctcctactgtgataagtccttccggcagctntcccacctccagcagcacaccagaatccacacaggcgacagaccctacaagtgcccacatcctggctgcgagaaggctttcactcagctctccaacctccagtctcaccagcgccagcacaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaagaaaaaaagtaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagatttttttttggtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggcttttggttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtcagtcatcactaacattctaagaaaaaagaaaaagaaaaaaagaaaaaaaaaaaaaca

SEQ ID NO: 439597 - DNA, 2011 bp, Homo sapiens
cgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgcccctgagatgctcatgcccttggattaaacccctgcagtgctggaagaagaggactctgcactgcctgccacaccaggactggaagatccatggccttcccttcttccaaactaccttcccacaagatggggatggtggtcacatctccaacactagcatgctgtggaagagacatcagcattcttgcaacaaatctggaaacagcctaaagagacatttctacttcaaagagttgcactgaggaagtgcactggcactgctggggactcacctggggcccagggctgaggcttctcgtgtccttggagctgctgtcctcccgaggagtgtccacactgcagccagctcagcctcaggtgtcttctctggttttgaaaccaaatctaagtgggaaaagaagattcaagttttatccgatttagtctacataattttaagtatctatttgagctcaataccaagaatcacttccttctctctcccatctgtgatctccagaggaaaggtccccgggctaggagacactggctggcatcctaaagccagagctggccaaagggtgtgtgtccactcttccttcacctcttccccaccccacacttgtttttgtctcacgctcacttgctctttctgcctccctctcactctttaggtctcacaaaggctttggccaaagactgactgactttccttggctctctgtcatctccccatagtcaaaagcatttcataacacacaatccatgtgaagggacctctgatgaaaatccatttaaagaggagctcactaattatcaatacttactgctgagcctggaatcattcatatatacctcagagttcattcattccagatgcaatactagataaggagactcctatgaaccaaatatctaactctgaatagatagtgactgtcataatcaaaccctgtggctgcctcctccttactggagggtgtagaggaatgcagttttttgtttgtttatttgtttgttctgagattgcatcactgcactccagcctgggtgatagagtgagactctgtctcaaaacaaaacagtagaaaagaaacaaaaaccatgtgatgagaaacgggactttatggcagcactgacctcactgtcctcaatatgacctattaaagaacaagcattctgagcattctgtaatattggttccaggtatcaattacaacctatcatgatcatggtgaccctattacctatattctctagagcatgcaaatatgatttaattttctcctaccaggaaaaaggcccaatttcacttccttcccccatcaatgaatacaccagaccacatgttccatgattggtaaaaggcagagataggggtcttactttcagttcattcttaacatggtgtaattggagactgcttagcccagcttgtcttttttctttgaccccaaggaaatgaaacaaaaatacaagcccacctgtatcctag

SEQ ID NO: 439598 - DNA, 715 bp, Homo sapiens
cgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccaggtgagttaatatgtactgcacagattcacatcaggggatttgttgtttcccagtagttaattcagggtttggcaactttggaagatttttcaagaacatctccatagggatcctaacctctggaagtgatggagaatattgattcctaaatcaaacttccagatactactcacaaaaaattcctcctttttgaatcgttttttgaatgtttactattcttacacctgccaatagttcagtctttgcccacctcaactttactgttgtttttcttggttatcatttttctccaagcactttcagtgtcctaccttgcc

SEQ ID NO: 439599 - DNA, 480 bp, Homo sapiens
cttcctgcttcaaaggcctgaagtctagactgcttggtccaaatcctaaattatttcctgttaacagggtattgtgttcacaaaccagaggtgatcttcaggctgcaacaaggagaagagccatggaaacaggaggaagaattcccaagccaaagctttccaggctcctcttggctatggtggtttcccagactttccttgttttggatgaccttgacagttgaggagtcctggtgagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttagga

SEQ ID NO: 439600 - DNA, 357 bp, Homo sapiens
ctcatctgaatctaatctcgagtataaccatcagacaaacccaaattgagagacagtttacaaaacaccagccttgtactctgcttaatatgtcaatgtcacaagagagaaagacaagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttagga

SEQ ID NO: 439601 - DNA, 6564 bp, Homo sapiens
ttctgtgatttgtaaatataaatctgtagttctcagtaatattcttgaaaatggtaaatgatcaaatactttggagaccattggtctaaaattactctataacccatttccttggctttttttctcaagacagcaccaggccatctcctgtgctgtctgccattttgttgatgtctgcagtgtgttggaggccctcacctttgcttgtatcatggccctatgcttatgaagaacgtaatagagtgtttttcataattcaaccaacagctgtacttcctcagttaagctcaaaacagagccaactttgctcctaatgttagtctactgtgtttgtactttcaccttagtacttgtaacatattaccacacatattttcttaccactctgtgtgttctttgaacacaggaagatttttattaatcttagtatttccagcagtgatgatagttccaggtactttgtaggaacttgataatttcttttgcatgaattaatatcttaatgcattaatggcagaatatttctgttatgatttctttttccctaaaagtataaaacaaaacaatattctgtgaataataatcatggtaaggattagcccatacttcttttttcatgccacctaattctgaatgtttcaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattcccatgtacacttcaccaaacttcctctaaggataatgtataatcatagtatatggtcaagtccaagaaatcgatgttaccttgctggtagatagagacttagtcagattttactatggtttgcatgcactctgtgtgtgtgtgtacgtgtatgtgtgtgtgtgtggttatatcaaacttttacgacttttacatttgagtaaccatcaacacgattagtttacagaactgaaaaggaatctgagatctgtactgtatcaggattacaaaggatttagcctcaagtagttccctttttgtattaataaccacacgctttctgcaaccctatcccttgcatccacttgactatgaagtttttttaaagcacagataaattgaataatcagggcaatagcattaagcacatctgcgaattatccctgaagttcaaaagacttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctcagacttttgagaatatgaagaggagggttgaggctggagcagaaccagaatcaagctggtgtggggcttttattgatagtgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttagctaaaatggaccaattccttgcaagacgcattctctcaaagctcacacaagatagacctcaataggcatatgtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattaccctaatagcaaaaccaggcaaagatattacaagaaaggaaaactacagatcaatatttccattgaacacagatgcagaaatcctcaaaatattagcaaatcaggaatgcaaggcttgttcaacatttgatattcagtgtaatccattgcatgcattagcagctcaaagatgaaatacgatcatatcaataggtacagaaaaagcatttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaaagaaataaaatgcacatagatttgaaaggatgaaatacaactttgttcacaagtaacatgattgtctttgtagagaattctaaataacaaaaaccctgctgacattaataagcaattacagcaggattgcaggatacagtcctcaggtagatgataaaaaggaattggacatcaagtcattaaaagacacggagaaaccctaaatgcttattgttaagtgaaaaccaatctgaaaaggctttctattttgtatgattgcaattatatgacattttgggagaggcaaaactattgagccagtgaaaggaccagtggttgctgagagttgaggggaaaggagggatggcaggtagagaggtgatttttaaggcagtgaaagtactctctagggtactgtaatttgtcaaaacgcagagaatggaaaacagtgaacggaaaacacagagtaaaccctaatgtcaactctggacttcagttaataataatgtatcactgttggctcattaattgtaacaaatgaaccataatgatgcaagatgttaatgattggggagcctgtggaagatgggaggggaaagggttatatgagaattctctatactttttgctcaactttctgtaaccctaaagctactctaaaaaatgaagtgtatcaagtaaataaataaccaaccaaccaa

SEQ ID NO: 439602 - DNA, 5844 bp, Homo sapiens
cttcctgcttcaaaggcctgaagtctagactgcttggtccaaatcctaaattatttcctgttaacagggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattcccatgtacacttcaccaaacttcctctaaggataatgtataatcatagtatatggtcaagtccaagaaatcgatgttaccttgctggtagatagagacttagtcagattttactatggtttgcatgcactctgtgtgtgtgtgtacgtgtatgtgtgtgtgtgtggttatatcaaacttttacgacttttacatttgagtaaccatcaacacgattagtttacagaactgaaaaggaatctgagatctgtactgtatcaggattacaaaggatttagcctcaagtagttccctttttgtattaataaccacacgctttctgcaaccctatcccttgcatccacttgactatgaagtttttttaaagcacagataaattgaataatcagggcaatagcattaagcacatctgcgaattatccctgaagttcaaaagacttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctcagacttttgagaatatgaagaggagggttgaggctggagcagaaccagaatcaagctggtgtggggcttttattgatagtgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttagctaaaatggaccaattccttgcaagacgcattctctcaaagctcacacaagatagacctcaataggcatatgtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattaccctaatagcaaaaccaggcaaagatattacaagaaaggaaaactacagatcaatatttccattgaacacagatgcagaaatcctcaaaatattagcaaatcaggaatgcaaggcttgttcaacatttgatattcagtgtaatccattgcatgcattagcagctcaaagatgaaatacgatcatatcaataggtacagaaaaagcatttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaaagaaataaaatgcacatagatttgaaaggatgaaatacaactttgttcacaagtaacatgattgtctttgtagagaattctaaataacaaaaaccctgctgacattaataagcaattacagcaggattgcaggatacagtcctcaggtagatgataaaaaggaattggacatcaagtcattaaaagacacggagaaaccctaaatgcttattgttaagtgaaaaccaatctgaaaaggctttctattttgtatgattgcaattatatgacattttgggagaggcaaaactattgagccagtgaaaggaccagtggttgctgagagttgaggggaaaggagggatggcaggtagagaggtgatttttaaggcagtgaaagtactctctagggtactgtaatttgtcaaaacgcagagaatggaaaacagtgaacggaaaacacagagtaaaccctaatgtcaactctggacttcagttaataataatgtatcactgttggctcattaattgtaacaaatgaaccataatgatgcaagatgttaatgattggggagcctgtggaagatgggaggggaaagggttatatgagaattctctatactttttgctcaactttctgtaaccctaaagctactctaaaaaatgaagtgtatcaagtaaataaataaccaaccaaccaa

SEQ ID NO: 439603 - DNA, 6295 bp, Homo sapiens
cgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattcccatgtacacttcaccaaacttcctctaaggataatgtataatcatagtatatggtcaagtccaagaaatcgatgttaccttgctggtagatagagacttagtcagattttactatggtttgcatgcactctgtgtgtgtgtgtacgtgtatgtgtgtgtgtgtggttatatcaaacttttacgacttttacatttgagtaaccatcaacacgattagtttacagaactgaaaaggaatctgagatctgtactgtatcaggattacaaaggatttagcctcaagtagttccctttttgtattaataaccacacgctttctgcaaccctatcccttgcatccacttgactatgaagtttttttaaagcacagataaattgaataatcagggcaatagcattaagcacatctgcgaattatccctgaagttcaaaagacttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctcagacttttgagaatatgaagaggagggttgaggctggagcagaaccagaatcaagctggtgtggggcttttattgatagtgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttagctaaaatggaccaattccttgcaagacgcattctctcaaagctcacacaagatagacctcaataggcatatgtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattaccctaatagcaaaaccaggcaaagatattacaagaaaggaaaactacagatcaatatttccattgaacacagatgcagaaatcctcaaaatattagcaaatcaggaatgcaaggcttgttcaacatttgatattcagtgtaatccattgcatgcattagcagctcaaagatgaaatacgatcatatcaataggtacagaaaaagcatttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaaagaaataaaatgcacatagatttgaaaggatgaaatacaactttgttcacaagtaacatgattgtctttgtagagaattctaaataacaaaaaccctgctgacattaataagcaattacagcaggattgcaggatacagtcctcaggtagatgataaaaaggaattggacatcaagtcattaaaagacacggagaaaccctaaatgcttattgttaagtgaaaaccaatctgaaaaggctttctattttgtatgattgcaattatatgacattttgggagaggcaaaactattgagccagtgaaaggaccagtggttgctgagagttgaggggaaaggagggatggcaggtagagaggtgatttttaaggcagtgaaagtactctctagggtactgtaatttgtcaaaacgcagagaatggaaaacagtgaacggaaaacacagagtaaaccctaatgtcaactctggacttcagttaataataatgtatcactgttggctcattaattgtaacaaatgaaccataatgatgcaagatgttaatgattggggagcctgtggaagatgggaggggaaagggttatatgagaattctctatactttttgctcaactttctgtaaccctaaagctactctaaaaaatgaagtgtatcaagtaaataaataaccaaccaaccaaccctgaggaacatcttgtttctgtactaaggtgttcttttgttagttgtatgtttctgactgaacatgtaaatcatcattagtgaacaattgaattgcttttgtacatccttaatatattttaaattatggtaactgtgacctgaaattaaggactagtatttttggttctcttgacatctgaagccaatagggcctcaaatgacctaacctcatt

SEQ ID NO: 439604 - DNA, 2041 bp, Homo sapiens
  misc_feature (1094)..(1094): n is a, c, g, or t
  misc_feature (1334)..(1334): n is a, c, g, or t
  misc_feature (1595)..(1595): n is a, c, g, or t
ttctgtgatttgtaaatataaatctgtagttctcagtaatattcttgaaaatggtaaatgatcaaatactttggagaccattggtctaaaattactctataacccatttccttggctttttttctcaagacagcaccaggccatctcctgtgctgtctgccattttgttgatgtctgcagtgtgttggaggccctcacctttgcttgtatcatggccctatgcttatgaagaacgtaatagagtgtttttcataattcaaccaacagctgtacttcctcagttaagctcaaaacagagccaactttgctcctaatgttagtctactgtgtttgtactttcaccttagtacttgtaacatattaccacacatattttcttaccactctgtgtgttctttgaacacaggaagatttttattaatcttagtatttccagcagtgatgatagttccaggtactttgtaggaacttgataatttcttttgcatgaattaatatcttaatgcattaatggcagaatatttctgttatgatttctttttccctaaaagtataaaacaaaacaatattctgtgaataataatcatggtaaggattagcccatacttcttttttcatgccacctaattctgaatgtttcaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagagatggggtttcaccatgttcctgggctggtcttaaactcctgagttcaagtgatccacctgccttggcctcccaaagtggtaggattacaggcatgagccacagcatcccacctgtaatggggagttttaaatttacaacttcaatctttttacttgtgtaggtcttttcagatttttctttttctacttgagttggttttagttgtttntgttttatggattttcccattttgttgaagttaaataatttgttggcatacattgttcataccattctttgtaattatttttatttctgtaagagtactagtaatacatctttaatccctacttttagtaatttgaaccttctctctcttttttttctttttcaatgtcagtctagctagaggtttgtatattttgttgatcttttccaggaatcagctattgtttttctgttctctagntcattaatttttactctataatctttctgctttcctgccttctgcttgatttggttttgtattgctgctcctgtccaagtgttttaaggtggaaaattagtttactgatttgagatctttttaaatatggttattacagctacaaatctctaaggattgctttatctgtgttccataagtttgagtatgtcttcatttttatctcaaagcattttttctaattttccttcttattgcttctttaacttttttttttaactncggaatatgttatataatttgtgcatgtttgtgcattctaaaaattcctttgtcttactgatttgtaattcgactgtggtcagagaatcattttaaatttattctggggaatgtttcatgtgtacttttgaagcatacctgctccactgttcgagtggaatgttctgtctatatctcttagatctggttgctttagagtgtcatctatatcttctgtttccatgtttatattgtgcccagttgtcctaaccattattgaaaatggggtattacagtttgcaataagtattgtagacttgtatatttttttcttttaattctgtcagtttttgctacacatactttgaggctctgttagtagtacatacgcttagaattgttatgtctcctttattgattgacccttttattgttatattaataaaattcccctctttatccttagt

SEQ ID NO: 439605 - DNA, 2251 bp, Homo sapiens
gaagcagacatagcttggtaatctgtggtgtattctcggaaggtaccacttgaatgggaaagaggagacagacaaagacaaccaagaggcttgaacttgacaaaaattatttataacaaaatgggcagctttgtgcatagaggtgcatgtaaatatatacaaaatgctaatagtatcagaagatgaacatcctgctttgttcagtgatttcatggagttgttttgcatttccttgtcatgttctctgtctacatgtttaaagggaggattacatgtgaacactatccggtattatgcatctaagcttgtgttaccaatcattggtagatagatagtgaggtaacttctagttcccatctcctctggtaagagctaagatgcaaactctttgtgatgaactgacatcaagatgaaatatagcacccctgttttctctgcgtcagtctgccttcaggctcaccctgtgaactcaccaaagggagtgaagtgtggatgtgtctcttttacctattttcaccttggttcagttctggtttatgcattgtccagactacccaggatgtgacgattgcagggaggaggtcatgtttgtcataaaaatgctttggctccttaggattcagcaaaggtatccactgcctggtgtctgtggtgcctgcaggacagtgcattctgtaggaaaacaggaagaaaagagggctttcaggccatcttcacatcaaccctacgacagacattttcaaatattgttctcaccatccttactccctcccaggcccctgagatgctcatgcccttggattaaacccctgcagtgctggaagaagaggactctgcactgcctgccacaccaggactggaagatccatggccttcccttcttccaaactaccttcccacaagatggggatggtggtcacatctccaacactagcatgctgtggaagagacatcagcattcttgcaacaaatctggaaacagcctaaagagacatttctacttcaaagagttgcactgaggaagtgcactggcactgctggggactcacctggggcccagggctgaggcttctcgtgtccttggagctgctgtcctcccgaggagtgtccacactgcagccagctcagcctcaggtgtcttctctggttttgaaaccaaatctaagtgggaaaagaagattcaagttttatccgatttagtctacataattttaagtatctatttgagctcaataccaagaatcacttccttctctctcccatctgtgatctccagaggaaaggtccccgggctaggagacactggctggcatcctaaagccagagctggccaaagggtgtgtgtccactcttccttcacctcttccccaccccacacttgtttttgtctcacgctcacttgctctttctgcctccctctcactctttaggtctcacaaaggctttggccaaagactgactgactttccttggctctctgtcatctccccatagtcaaaagcatttcataacacacaatccatgtgaagggacctctgatgaaaatccatttaaagaggagctcactaattatcaatacttactgctgagcctggaatcattcatatatacctcagagttcattcattccagatgcaatactagataaggagactcctatgaaccaaatatctaactctgaatagatagtgactgtcataatcaaaccctgtggctgcctcctccttactggagggtgtagaggaatgcagttttttgtttgtttatttgtttgttctgagattgcatcactgcactccagcctgggtgatagagtgagactctgtctcaaaacaaaacagtagaaaagaaacaaaaaccatgtgatgagaaacgggactttatggcagcactgacctcactgtcctcaatatgacctattaaagaacaagcattctgagcattctgtaatattggttccaggtatcaattacaacctatcatgatcatggtgaccctattacctatattctctagagcatgcaaatatgatttaattttctcctaccaggaaaaaggcccaatttcacttccttcccccatcaatgaatacaccagaccacatgttccatgattggtaaaaggcagagataggggtcttactttcagttcattcttaacatggtgtaattggagactgcttagcccagcttgtcttttttctttgaccccaaggaaatgaaacaaaaatacaagcccacctgtatcctag

SEQ ID NO: 439606 - DNA, 1176 bp, Homo sapiens
ttctgtgatttgtaaatataaatctgtagttctcagtaatattcttgaaaatggtaaatgatcaaatactttggagaccattggtctaaaattactctataacccatttccttggctttttttctcaagacagcaccaggccatctcctgtgctgtctgccattttgttgatgtctgcagtgtgttggaggccctcacctttgcttgtatcatggccctatgcttatgaagaacgtaatagagtgtttttcataattcaaccaacagctgtacttcctcagttaagctcaaaacagagccaactttgctcctaatgttagtctactgtgtttgtactttcaccttagtacttgtaacatattaccacacatattttcttaccactctgtgtgttctttgaacacaggaagatttttattaatcttagtatttccagcagtgatgatagttccaggtactttgtaggaacttgataatttcttttgcatgaattaatatcttaatgcattaatggcagaatatttctgttatgatttctttttccctaaaagtataaaacaaaacaatattctgtgaataataatcatggtaaggattagcccatacttcttttttcatgccacctaattctgaatgtttcaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccaggctcctcttggctatggtggtttcccagactttccttgttttggatgaccttgacagttgaggagtcctggtgaggtatatataaattccatttattgggatgtgtctgatgtttttctcaagataagactgggattataggttttgggggaaaaagcccacagtggtaaagtaccttttttgtcacattatatcaagcatgcatactgtcaccatgttttatgacttttgatgttggcctgaaatgtcttggcaaacagagtttgtccactataaagttacatctttttcct

SEQ ID NO: 439607 - DNA, 6079 bp, Homo sapiens
cgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattcccatgtacacttcaccaaacttcctctaaggataatgtataatcatagtatatggtcaagtccaagaaatcgatgttaccttgctggtagatagagacttagtcagattttactatggtttgcatgcactctgtgtgtgtgtgtacgtgtatgtgtgtgtgtgtggttatatcaaacttttacgacttttacatttgagtaaccatcaacacgattagtttacagaactgaaaaggaatctgagatctgtactgtatcaggattacaaaggatttagcctcaagtagttccctttttgtattaataaccacacgctttctgcaaccctatcccttgcatccacttgactatgaagtttttttaaagcacagataaattgaataatcagggcaatagcattaagcacatctgcgaattatccctgaagttcaaaagacttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctcagacttttgagaatatgaagaggagggttgaggctggagcagaaccagaatcaagctggtgtggggcttttattgatagtgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttagctaaaatggaccaattccttgcaagacgcattctctcaaagctcacacaagatagacctcaataggcatatgtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattaccctaatagcaaaaccaggcaaagatattacaagaaaggaaaactacagatcaatatttccattgaacacagatgcagaaatcctcaaaatattagcaaatcaggaatgcaaggcttgttcaacatttgatattcagtgtaatccattgcatgcattagcagctcaaagatgaaatacgatcatatcaataggtacagaaaaagcatttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaaagaaataaaatgcacatagatttgaaaggatgaaatacaactttgttcacaagtaacatgattgtctttgtagagaattctaaataacaaaaaccctgctgacattaataagcaattacagcaggattgcaggatacagtcctcaggtagatgataaaaaggaattggacatcaagtcattaaaagacacggagaaaccctaaatgcttattgttaagtgaaaaccaatctgaaaaggctttctattttgtatgattgcaattatatgacattttgggagaggcaaaactattgagccagtgaaaggaccagtggttgctgagagttgaggggaaaggagggatggcaggtagagaggtgatttttaaggcagtgaaagtactctctagggtactgtaatttgtcaaaacgcagagaatggaaaacagtgaacggaaaacacagagtaaaccctaatgtcaactctggacttcagttaataataatgtatcactgttggctcattaattgtaacaaatgaaccataatgatgcaagatgttaatgattggggagcctgtggaagatgggaggggaaagggttatatgagaattctctatactttttgctcaactttctgtaaccctaaagctactctaaaaaatgaagtgtatcaagtaaataaataaccaaccaaccaa

SEQ ID NO: 439608 - DNA, 640 bp, Homo sapiens
cgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttagga

SEQ ID NO: 439609 - DNA, 6025 bp, Homo sapiens
cgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattcccatgtacacttcaccaaacttcctctaaggataatgtataatcatagtatatggtcaagtccaagaaatcgatgttaccttgctggtagatagagacttagtcagattttactatggtttgcatgcactctgtgtgtgtgtgtacgtgtatgtgtgtgtgtgtggttatatcaaacttttacgacttttacatttgagtaaccatcaacacgattagtttacagaactgaaaaggaatctgagatctgtactgtatcaggattacaaaggatttagcctcaagtagttccctttttgtattaataaccacacgctttctgcaaccctatcccttgcatccacttgactatgaagtttttttaaagcacagataaattgaataatcagggcaatagcattaagcacatctgcgaattatccctgaagttcaaaagacttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctcagacttttgagaatatgaagaggagggttgaggctggagcagaaccagaatcaagctggtgtggggcttttattgatagtgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttaggacctcaataggcatatgtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattaccctaatagcaaaaccaggcaaagatattacaagaaaggaaaactacagatcaatatttccattgaacacagatgcagaaatcctcaaaatattagcaaatcaggaatgcaaggcttgttcaacatttgatattcagtgtaatccattgcatgcattagcagctcaaagatgaaatacgatcatatcaataggtacagaaaaagcatttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaaagaaataaaatgcacatagatttgaaaggatgaaatacaactttgttcacaagtaacatgattgtctttgtagagaattctaaataacaaaaaccctgctgacattaataagcaattacagcaggattgcaggatacagtcctcaggtagatgataaaaaggaattggacatcaagtcattaaaagacacggagaaaccctaaatgcttattgttaagtgaaaaccaatctgaaaaggctttctattttgtatgattgcaattatatgacattttgggagaggcaaaactattgagccagtgaaaggaccagtggttgctgagagttgaggggaaaggagggatggcaggtagagaggtgatttttaaggcagtgaaagtactctctagggtactgtaatttgtcaaaacgcagagaatggaaaacagtgaacggaaaacacagagtaaaccctaatgtcaactctggacttcagttaataataatgtatcactgttggctcattaattgtaacaaatgaaccataatgatgcaagatgttaatgattggggagcctgtggaagatgggaggggaaagggttatatgagaattctctatactttttgctcaactttctgtaaccctaaagctactctaaaaaatgaagtgtatcaagtaaataaataaccaaccaaccaa

SEQ ID NO: 439610 - DNA, 5988 bp, Homo sapiens
cgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattcccatgtacacttcaccaaacttcctctaaggataatgtataatcatagtatatggtcaagtccaagaaatcgatgttaccttgctggtagatagagacttagtcagattttactatggtttgcatgcactctgtgtgtgtgtgtacgtgtatgtgtgtgtgtgtggttatatcaaacttttacgacttttacatttgagtaaccatcaacacgattagtttacagaactgaaaaggaatctgagatctgtactgtatcaggattacaaaggatttagcctcaagtagttccctttttgtattaataaccacacgctttctgcaaccctatcccttgcatccacttgactatgaagtttttttaaagcacagataaattgaataatcagggcaatagcattaagcacatctgcgaattatccctgaagttcaaaagacttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctcagacttttgagaatatgaagaggagggttgaggctggagcagaaccagaatcaagctggtgtggggcttttattgatagtgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttagctaaaatggaccaattccttgcaagacgcattctctcaaagctcacacaagatagacctcaataggcatatgtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattaccctaatagcaaaaccaggcaaagatattacaagaaaggaaaactacagatcaatatttccattgaacacagatgcagaaatcctcaaaatattagcaaatcaggaatgcaaggcttgttcaacatttgatattcagtgtaatccattgcatgcattagcagctcaaagatgaaatacgatcatatcaataggtacagaaaaagcatttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaaagaaataaaatgcacatagatttgaaaggatgaaatacaactttgttcacaagtaacatgattgtctttgtagagaattctaaataacaaaaaccctgctgacattaataagcaatttattgttaagtgaaaaccaatctgaaaaggctttctattttgtatgattgcaattatatgacattttgggagaggcaaaactattgagccagtgaaaggaccagtggttgctgagagttgaggggaaaggagggatggcaggtagagaggtgatttttaaggcagtgaaagtactctctagggtactgtaatttgtcaaaacgcagagaatggaaaacagtgaacggaaaacacagagtaaaccctaatgtcaactctggacttcagttaataataatgtatcactgttggctcattaattgtaacaaatgaaccataatgatgcaagatgttaatgattggggagcctgtggaagatgggaggggaaagggttatatgagaattctctatactttttgctcaactttctgtaaccctaaagctactctaaaaaatgaagtgtatcaagtaaataaataaccaaccaaccaa

SEQ ID NO: 439611 - DNA, 1556 bp, Homo sapiens
  misc_feature (609)..(609): n is a, c, g, or t
  misc_feature (849)..(849): n is a, c, g, or t
  misc_feature (1110)..(1110): n is a, c, g, or t
cgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagagatggggtttcaccatgttcctgggctggtcttaaactcctgagttcaagtgatccacctgccttggcctcccaaagtggtaggattacaggcatgagccacagcatcccacctgtaatggggagttttaaatttacaacttcaatctttttacttgtgtaggtcttttcagatttttctttttctacttgagttggttttagttgtttntgttttatggattttcccattttgttgaagttaaataatttgttggcatacattgttcataccattctttgtaattatttttatttctgtaagagtactagtaatacatctttaatccctacttttagtaatttgaaccttctctctcttttttttctttttcaatgtcagtctagctagaggtttgtatattttgttgatcttttccaggaatcagctattgtttttctgttctctagntcattaatttttactctataatctttctgctttcctgccttctgcttgatttggttttgtattgctgctcctgtccaagtgttttaaggtggaaaattagtttactgatttgagatctttttaaatatggttattacagctacaaatctctaaggattgctttatctgtgttccataagtttgagtatgtcttcatttttatctcaaagcattttttctaattttccttcttattgcttctttaacttttttttttaactncggaatatgttatataatttgtgcatgtttgtgcattctaaaaattcctttgtcttactgatttgtaattcgactgtggtcagagaatcattttaaatttattctggggaatgtttcatgtgtacttttgaagcatacctgctccactgttcgagtggaatgttctgtctatatctcttagatctggttgctttagagtgtcatctatatcttctgtttccatgtttatattgtgcccagttgtcctaaccattattgaaaatggggtattacagtttgcaataagtattgtagacttgtatatttttttcttttaattctgtcagtttttgctacacatactttgaggctctgttagtagtacatacgcttagaattgttatgtctcctttattgattgacccttttattgttatattaataaaattcccctctttatccttagt

SEQ ID NO: 439612 - DNA, 2285 bp, Homo sapiens
  misc_feature (1094)..(1094): n is a, c, g, or t
  misc_feature (1334)..(1334): n is a, c, g, or t
  misc_feature (1595)..(1595): n is a, c, g, or t
ttctgtgatttgtaaatataaatctgtagttctcagtaatattcttgaaaatggtaaatgatcaaatactttggagaccattggtctaaaattactctataacccatttccttggctttttttctcaagacagcaccaggccatctcctgtgctgtctgccattttgttgatgtctgcagtgtgttggaggccctcacctttgcttgtatcatggccctatgcttatgaagaacgtaatagagtgtttttcataattcaaccaacagctgtacttcctcagttaagctcaaaacagagccaactttgctcctaatgttagtctactgtgtttgtactttcaccttagtacttgtaacatattaccacacatattttcttaccactctgtgtgttctttgaacacaggaagatttttattaatcttagtatttccagcagtgatgatagttccaggtactttgtaggaacttgataatttcttttgcatgaattaatatcttaatgcattaatggcagaatatttctgttatgatttctttttccctaaaagtataaaacaaaacaatattctgtgaataataatcatggtaaggattagcccatacttcttttttcatgccacctaattctgaatgtttcaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagagatggggtttcaccatgttcctgggctggtcttaaactcctgagttcaagtgatccacctgccttggcctcccaaagtggtaggattacaggcatgagccacagcatcccacctgtaatggggagttttaaatttacaacttcaatctttttacttgtgtaggtcttttcagatttttctttttctacttgagttggttttagttgtttntgttttatggattttcccattttgttgaagttaaataatttgttggcatacattgttcataccattctttgtaattatttttatttctgtaagagtactagtaatacatctttaatccctacttttagtaatttgaaccttctctctcttttttttctttttcaatgtcagtctagctagaggtttgtatattttgttgatcttttccaggaatcagctattgtttttctgttctctagntcattaatttttactctataatctttctgctttcctgccttctgcttgatttggttttgtattgctgctcctgtccaagtgttttaaggtggaaaattagtttactgatttgagatctttttaaatatggttattacagctacaaatctctaaggattgctttatctgtgttccataagtttgagtatgtcttcatttttatctcaaagcattttttctaattttccttcttattgcttctttaacttttttttttaactncggaatatgttatataatttgtgcatgtttgtgcattctaaaaattcctttgtcttactgatttgtaattcgactgtggtcagagaatcattttaaatttattctggggaatgtttcatgtgtacttttgaagcatacctgctccactgttcgagtggaatgttctgtctatatctcttagatctggttgctttagagtgtcatctatatcttctgtttccatgtttatattgtgcccagttgtcctaaccattattgaaaatggggtattacagtttgcaataagtattgtagacttgtatatttttttcttttaattctgtcagtttttgctacacatactttgaggctctgttagtagtacatacgcttagaattgttatgtctcctttattgattgacccttttattgttatattaataaaattcccctctttatccttagtaaaatttttgtattaaagtgtattttgtgtgatattaggatagctactccagccttataggtgccatgtgccggatatatctttttctgtcttcaaattttcaacctgtttgtatctatctcttatagacagcacatgtttggattttcacacttttgacaacctgagaattgttgctttttgattggattttcaaatcattccctttttcctgttgttattgctatgcagatggttcctgact

SEQ ID NO: 439613 - DNA, 2707 bp, Homo sapiens
gggccggagggccgcggtgtgccgcggggcagttgcgggttgtcataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagacgaagccgagccgcggctcctagcggcggcgccgatgctcgagctgtagctgccaggcgaggatgtgtggagcgcaggcggcgcggggtaaatgagaggtctcgggccccaggacccccggggcccgggatgagttagcgagggcagccgcgggggccagttccgaccgtgacaggccaaggcgacggccgccgcccgcccgccccttccgtgcagaagcagctgctcctttccgcgcccgcccgcctgcgctcccggccctggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcatttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagtttcactctcttgacacacttattaggaagggattgcttcactggtttaataatttaaaagttatgtttgttaaacaccctgtcagaacagtcattttcagtattagattcctgtactattgtgttttgagtgtgttttggaaccttcatagaacacactttcttttggaatgtatttgattgataagaaagtttaaacattgttttcacctcaatgtagaaatacagtggttttgtttttttttttcttttagtgctgacaaaataaaatactcatttttgcataaaaaggttcctaatccttttgcagaataagttttgtttactctttataccaaaattcagtgaaggcattctacaagttttgagttagcattacattttaatatttactattgctacattgtataattgagtttgaaataaaacccagcttatgacaat

SEQ ID NO: 439614 - DNA, 4202 bp, Homo sapiens
gggccggagggccgcggtgtgccgcggggcagttgcgggttgtcataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagacgaagccgagccgcggctcctagcggcggcgccgatgctcgagctgtagctgccaggcgaggatgtgtggagcgcaggcggcgcggggtaaatgagaggtctcgggccccaggacccccggggcccgggatgagttagcgagggcagccgcgggggccagttccgaccgtgacaggccaaggcgacggccgccgcccgcccgccccttccgtgcagaagcagctgctcctttccgcgcccgcccgcctgcgctcccggccctggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcatttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagtttcactctcttgacacacttattaggaagggattgcttcactggtttaataatttaaaagttatgtttgttaaacaccctgtcagaacagtcattttcagtattagattcctgtactattgtgttttgagtgtgttttggaaccttcatagaacacactttcttttggaatgtatttgattgataagaaagtttaaacattgttttcacctcaatgtagaaatacagtggttttgtttttttttttcttttagtgctgacaaaataaaatactcatttttgcataaaaaggttcctaatccttttgcagaataagttttgtttactctttataccaaaattcagtgaaggcattctacaagttttgagttagcattacattttaatatttactattgctacattgtataattgagtttgaaataaaacccagcttatgacaatgcattccctgtgcaagaaactgtttggctttcaaattacccaggcattgaaaatgaatgataaaaagttgctgtgtaagggaaatacagcctaaattgtttttgaaagccagaaatgatacaaagttcagtcatgccaaagtgaaatactttctagtgccagctttaacttaaatcatacgttttaaaaggacagatacagaaaattataggaaacaggcttaaattttgctccatatttaatgtagacgtttatagaagtttcccttaatttgtaattgcattcaaccgagaatttctcataaaagactaatttctgtgtaaagatattacgggctgggtgtggtggctcatgtctgtaatcccagcactctgggaggttgaggcaggcagattgcttgaactcaagagtttgagaccagcctgggcaacatggcgaaaacccatctctactaaaaatacaaaaaattagccgggtgtagtggtgcatctgtagtcccagctacttgagaggctgaggtgggaggatcctttgagtctcgaggcagaggttgcagtgagcctagagcgtgccactgcacgccagcctgagcaacagagcaaggctccatctaaagaaaaaaaaaaaaagttacttaaacttgtaactattaaatggcagtctcaaaattattgcatcaatttaagattcatagtagtttaagagcacatatgcttatctaaggtgaggcaaatagttctcttgctttacgagctacctttagacttacccacggcccagtctggtgcaagattttgcctgggggttataaataagggtgaatcaggaggctttgtacctatttctggtactctgacctgacatcactagttcaaagaactaaaaaattaggttatttccaggactgagctaagaaggccagagtgtgaagtagtagctgtttttgaaacaaatagatcagctcctggctttggggttagtgattaaatcaacaaatatttccctttctgtatttccttcctttcattttctttggctgccctaaaattttttgtaagaaaaaaacctgttaggatcttctctttgcctcacattttaggtgttataaaggaaattgattatgcaggaggctgagatgagaggatcacttgagcctaagagtttgaatccagtctggacaacatagcaagacccatctcttaaaaaaaaagaaagtgattaggaaacactggcttttttttgtttttctgtgtaataatgtaatgaaggcaattttcctatcagagcaaattgccagattttaaaaattccagttttactcttaaatttctataaaaccacaagatgttttaatatttcaataacttctaagaaatacttcaaaattgaattttgaaaatcattactaaataactaaatctattatatatactttatgtaacaaaaatatatatagtttgtgtgacaaaatatagagctgatgaaaaataaaaaa

SEQ ID NO: 439615 - DNA, 4148 bp, Homo sapiens
gggccggagggccgcggtgtgccgcggggcagttgcgggttgtcataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagacgaagccgagccgcggctcctagcggcggcgccgatgctcgagctgtagctgccaggcgaggatgtgtggagcgcaggcggcgcggggtaaatgagaggtctcgggccccaggacccccggggcccgggatgagttagcgagggcagccgcgggggccagttccgaccgtgacaggccaaggcgacggccgccgcccgcccgccccttccgtgcagaagcagctgctcctttccgcgcccgcccgcctgcgctcccggccctggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcggaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcatttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagtttcactctcttgacacacttattaggaagggattgcttcactggtttaataatttaaaagttatgtttgttaaacaccctgtcagaacagtcattttcagtattagattcctgtactattgtgttttgagtgtgttttggaaccttcatagaacacactttcttttggaatgtatttgattgataagaaagtttaaacattgttttcacctcaatgtagaaatacagtggttttgtttttttttttcttttagtgctgacaaaataaaatactcatttttgcataaaaaggttcctaatccttttgcagaataagttttgtttactctttataccaaaattcagtgaaggcattctacaagttttgagttagcattacattttaatatttactattgctacattgtataattgagtttgaaataaaacccagcttatgacaatgcattccctgtgcaagaaactgtttggctttcaaattacccaggcattgaaaatgaatgataaaaagttgctgtgtaagggaaatacagcctaaattgtttttgaaagccagaaatgatacaaagttcagtcatgccaaagtgaaatactttctagtgccagctttaacttaaatcatacgttttaaaaggacagatacagaaaattataggaaacaggcttaaattttgctccatatttaatgtagacgtttatagaagtttcccttaatttgtaattgcattcaaccgagaatttctcataaaagactaatttctgtgtaaagatattacgggctgggtgtggtggctcatgtctgtaatcccagcactctgggaggttgaggcaggcagattgcttgaactcaagagtttgagaccagcctgggcaacatggcgaaaacccatctctactaaaaatacaaaaaattagccgggtgtagtggtgcatctgtagtcccagctacttgagaggctgaggtgggaggatcctttgagtctcgaggcagaggttgcagtgagcctagagcgtgccactgcacgccagcctgagcaacagagcaaggctccatctaaagaaaaaaaaaaaaagttacttaaacttgtaactattaaatggcagtctcaaaattattgcatcaatttaagattcatagtagtttaagagcacatatgcttatctaaggtgaggcaaatagttctcttgctttacgagctacctttagacttacccacggcccagtctggtgcaagattttgcctgggggttataaataagggtgaatcaggaggctttgtacctatttctggtactctgacctgacatcactagttcaaagaactaaaaaattaggttatttccaggactgagctaagaaggccagagtgtgaagtagtagctgtttttgaaacaaatagatcagctcctggctttggggttagtgattaaatcaacaaatatttccctttctgtatttccttcctttcattttctttggctgccctaaaattttttgtaagaaaaaaacctgttaggatcttctctttgcctcacattttaggtgttataaaggaaattgattatgcaggaggctgagatgagaggatcacttgagcctaagagtttgaatccagtctggacaacatagcaagacccatctcttaaaaaaaaagaaagtgattaggaaacactggcttttttttgtttttctgtgtaataatgtaatgaaggcaattttcctatcagagcaaattgccagattttaaaaattccagttttactcttaaatttctataaaaccacaagatgttttaatatttcaataacttctaagaaatacttcaaaattgaattttgaaaatcattactaaataactaaatctattatatatactttatgtaacaaaaatatatatagtttgtgtgacaaaatatagagctgatgaaaaataaaaaa

SEQ ID NO: 439616 - DNA, 4005 bp, Homo sapiens
gggccggagggccgcggtgtgccgcggggcagttgcgggttgtcataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagacgaagccgagccgcggctcctagcggcggcgccgatgctcgagctgtagctgcgctcccggccctggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcatttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagtttcactctcttgacacacttattaggaagggattgcttcactggtttaataatttaaaagttatgtttgttaaacaccctgtcagaacagtcattttcagtattagattcctgtactattgtgttttgagtgtgttttggaaccttcatagaacacactttcttttggaatgtatttgattgataagaaagtttaaacattgttttcacctcaatgtagaaatacagtggttttgtttttttttttcttttagtgctgacaaaataaaatactcatttttgcataaaaaggttcctaatccttttgcagaataagttttgtttactctttataccaaaattcagtgaaggcattctacaagttttgagttagcattacattttaatatttactattgctacattgtataattgagtttgaaataaaacccagcttatgacaatgcattccctgtgcaagaaactgtttggctttcaaattacccaggcattgaaaatgaatgataaaaagttgctgtgtaagggaaatacagcctaaattgtttttgaaagccagaaatgatacaaagttcagtcatgccaaagtgaaatactttctagtgccagctttaacttaaatcatacgttttaaaaggacagatacagaaaattataggaaacaggcttaaattttgctccatatttaatgtagacgtttatagaagtttcccttaatttgtaattgcattcaaccgagaatttctcataaaagactaatttctgtgtaaagatattacgggctgggtgtggtggctcatgtctgtaatcccagcactctgggaggttgaggcaggcagattgcttgaactcaagagtttgagaccagcctgggcaacatggcgaaaacccatctctactaaaaatacaaaaaattagccgggtgtagtggtgcatctgtagtcccagctacttgagaggctgaggtgggaggatcctttgagtctcgaggcagaggttgcagtgagcctagagcgtgccactgcacgccagcctgagcaacagagcaaggctccatctaaagaaaaaaaaaaaaagttacttaaacttgtaactattaaatggcagtctcaaaattattgcatcaatttaagattcatagtagtttaagagcacatatgcttatctaaggtgaggcaaatagttctcttgctttacgagctacctttagacttacccacggcccagtctggtgcaagattttgcctgggggttataaataagggtgaatcaggaggctttgtacctatttctggtactctgacctgacatcactagttcaaagaactaaaaaattaggttatttccaggactgagctaagaaggccagagtgtgaagtagtagctgtttttgaaacaaatagatcagctcctggctttggggttagtgattaaatcaacaaatatttccctttctgtatttccttcctttcattttctttggctgccctaaaattttttgtaagaaaaaaacctgttaggatcttctctttgcctcacattttaggtgttataaaggaaattgattatgcaggaggctgagatgagaggatcacttgagcctaagagtttgaatccagtctggacaacatagcaagacccatctcttaaaaaaaaagaaagtgattaggaaacactggcttttttttgtttttctgtgtaataatgtaatgaaggcaattttcctatcagagcaaattgccagattttaaaaattccagttttactcttaaatttctataaaaccacaagatgttttaatatttcaataacttctaagaaatacttcaaaattgaattttgaaaatcattactaaataactaaatctattatatatactttatgtaacaaaaatatatatagtttgtgtgacaaaatatagagctgatgaaaaataaaaaa

SEQ ID NO: 439617 - DNA, 3826 bp, Homo sapiens
gggccggagggccgcggtgtgccgcggggcagttgcgggttgtcataacggtccccgccggagtgaggcgaggccgcgtcgctcagttctggccgtctagggcccctgtaaggatgagaaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcatttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagtttcactctcttgacacacttattaggaagggattgcttcactggtttaataatttaaaagttatgtttgttaaacaccctgtcagaacagtcattttcagtattagattcctgtactattgtgttttgagtgtgttttggaaccttcatagaacacactttcttttggaatgtatttgattgataagaaagtttaaacattgttttcacctcaatgtagaaatacagtggttttgtttttttttttcttttagtgctgacaaaataaaatactcatttttgcataaaaaggttcctaatccttttgcagaataagttttgtttactctttataccaaaattcagtgaaggcattctacaagttttgagttagcattacattttaatatttactattgctacattgtataattgagtttgaaataaaacccagcttatgacaatgcattccctgtgcaagaaactgtttggctttcaaattacccaggcattgaaaatgaatgataaaaagttgctgtgtaagggaaatacagcctaaattgtttttgaaagccagaaatgatacaaagttcagtcatgccaaagtgaaatactttctagtgccagctttaacttaaatcatacgttttaaaaggacagatacagaaaattataggaaacaggcttaaattttgctccatatttaatgtagacgtttatagaagtttcccttaatttgtaattgcattcaaccgagaatttctcataaaagactaatttctgtgtaaagatattacgggctgggtgtggtggctcatgtctgtaatcccagcactctgggaggttgaggcaggcagattgcttgaactcaagagtttgagaccagcctgggcaacatggcgaaaacccatctctactaaaaatacaaaaaattagccgggtgtagtggtgcatctgtagtcccagctacttgagaggctgaggtgggaggatcctttgagtctcgaggcagaggttgcagtgagcctagagcgtgccactgcacgccagcctgagcaacagagcaaggctccatctaaagaaaaaaaaaaaaagttacttaaacttgtaactattaaatggcagtctcaaaattattgcatcaatttaagattcatagtagtttaagagcacatatgcttatctaaggtgaggcaaatagttctcttgctttacgagctacctttagacttacccacggcccagtctggtgcaagattttgcctgggggttataaataagggtgaatcaggaggctttgtacctatttctggtactctgacctgacatcactagttcaaagaactaaaaaattaggttatttccaggactgagctaagaaggccagagtgtgaagtagtagctgtttttgaaacaaatagatcagctcctggctttggggttagtgattaaatcaacaaatatttccctttctgtatttccttcctttcattttctttggctgccctaaaattttttgtaagaaaaaaacctgttaggatcttctctttgcctcacattttaggtgttataaaggaaattgattatgcaggaggctgagatgagaggatcacttgagcctaagagtttgaatccagtctggacaacatagcaagacccatctcttaaaaaaaaagaaagtgattaggaaacactggcttttttttgtttttctgtgtaataatgtaatgaaggcaattttcctatcagagcaaattgccagattttaaaaattccagttttactcttaaatttctataaaaccacaagatgttttaatatttcaataacttctaagaaatacttcaaaattgaattttgaaaatcattactaaataactaaatctattatatatactttatgtaacaaaaatatatatagtttgtgtgacaaaatatagagctgatgaaaaataaaaaa

SEQ ID NO: 439618 - DNA, 1928 bp, Homo sapiens
gggccggagggccgcggtgtgccgcggggcagttgcgggttgtcataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagacgaagccgagccgcggctcctagcggcggcgccgatgctcgagctgtagctgccaggcgaggatgtgtggagcgcaggcggcgcggggtaaatgagaggtctcgggccccaggacccccggggcccgggatgagttagcgagggcagccgcgggggccagttccgaccgtgacaggccaaggcgacggccgccgcccgcccgccccttccgtgcagaagcagctgctcctttccgcgcccgcccgcctgcgctcccggccctggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcatttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactgg

SEQ ID NO: 439619 - DNA, 2549 bp, Homo sapiens
gggccggagggccgcggtgtgccgcggggcagttgcgggttgtcataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagacgaagccgagccgcggctcctagcggcggcgccgatgctcgagctgtagctgccaggcgaggatgtgtggagcgcaggcggcgcggggtaaatgagaggtctcgggccccaggacccccggggcccgggatgagttagcgagggcagccgcgggggccagttccgaccgtgacaggccaaggcgacggccgccgcccgcccgccccttccgtgcagaagcagctgctcctttccgcgcccgcccgcctgcgctcccggccctggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcatttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagtttcactctcttgacacacttattaggaagggattgcttcactggtttaataatttaaaagttatgtttgttaaacaccctgtcagaacagtcattttcagtattagattcctgtactattgtgttttgagtgtgttttggaaccttcatagaacacactttcttttggaatgtatttgattgataagaaagtttaaacattgttttcacctcaatgtagaaatacagtggttttgtttttttttttcttttagtgctgacaaaataaaatactcatttttgcata

SEQ ID NO: 439620 - DNA, 4022 bp, Homo sapiens
gggccggagggccgcggtgtgccgcggggcagttgcgggttgtcataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagacgaagccgagccgcgggcagccgcgggggccagttccgaccgtgacaggccaaggcgacggccgccgcccgcccgccccttccgtgcagaagcagctgctcctttccgcgcccgcccgcctgcgctcccggccctggagaccatgaggttccgcatctacaaacggaaggtgctaatcctgacgctcgtggtggccgcctgcggcttcgtcctctggagcagcaatgggcgacggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcatttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagtttcactctcttgacacacttattaggaagggattgcttcactggtttaataatttaaaagttatgtttgttaaacaccctgtcagaacagtcattttcagtattagattcctgtactattgtgttttgagtgtgttttggaaccttcatagaacacactttcttttggaatgtatttgattgataagaaagtttaaacattgttttcacctcaatgtagaaatacagtggttttgtttttttttttcttttagtgctgacaaaataaaatactcatttttgcataaaaaggttcctaatccttttgcagaataagttttgtttactctttataccaaaattcagtgaaggcattctacaagttttgagttagcattacattttaatatttactattgctacattgtataattgagtttgaaataaaacccagcttatgacaatgcattccctgtgcaagaaactgtttggctttcaaattacccaggcattgaaaatgaatgataaaaagttgctgtgtaagggaaatacagcctaaattgtttttgaaagccagaaatgatacaaagttcagtcatgccaaagtgaaatactttctagtgccagctttaacttaaatcatacgttttaaaaggacagatacagaaaattataggaaacaggcttaaattttgctccatatttaatgtagacgtttatagaagtttcccttaatttgtaattgcattcaaccgagaatttctcataaaagactaatttctgtgtaaagatattacgggctgggtgtggtggctcatgtctgtaatcccagcactctgggaggttgaggcaggcagattgcttgaactcaagagtttgagaccagcctgggcaacatggcgaaaacccatctctactaaaaatacaaaaaattagccgggtgtagtggtgcatctgtagtcccagctacttgagaggctgaggtgggaggatcctttgagtctcgaggcagaggttgcagtgagcctagagcgtgccactgcacgccagcctgagcaacagagcaaggctccatctaaagaaaaaaaaaaaaagttacttaaacttgtaactattaaatggcagtctcaaaattattgcatcaatttaagattcatagtagtttaagagcacatatgcttatctaaggtgaggcaaatagttctcttgctttacgagctacctttagacttacccacggcccagtctggtgcaagattttgcctgggggttataaataagggtgaatcaggaggctttgtacctatttctggtactctgacctgacatcactagttcaaagaactaaaaaattaggttatttccaggactgagctaagaaggccagagtgtgaagtagtagctgtttttgaaacaaatagatcagctcctggctttggggttagtgattaaatcaacaaatatttccctttctgtatttccttcctttcattttctttggctgccctaaaattttttgtaagaaaaaaacctgttaggatcttctctttgcctcacattttaggtgttataaaggaaattgattatgcaggaggctgagatgagaggatcacttgagcctaagagtttgaatccagtctggacaacatagcaagacccatctcttaaaaaaaaagaaagtgattaggaaacactggcttttttttgtttttctgtgtaataatgtaatgaaggcaattttcctatcagagcaaattgccagattttaaaaattccagttttactcttaaatttctataaaaccacaagatgttttaatatttcaataacttctaagaaatacttcaaaattgaattttgaaaatcattactaaataactaaatctattatatatactttatgtaacaaaaatatatatagtttgtgtgacaaaatatagagctgatgaaaaataaaaaa

SEQ ID NO: 439621 - DNA, 2903 bp, Homo sapiens
agtgatcctcttctaggaaaagtataaggccagcataatctcgaagaattttcactctttccccagacttttaccatgtcttcaaaaagatgtggaaactgcgactggcactataggtccccagggagagaacatcacattcagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagtttcactctcttgacacacttattaggaagggattgcttcactggtttaataatttaaaagttatgtttgttaaacaccctgtcagaacagtcattttcagtattagattcctgtactattgtgttttgagtgtgttttggaaccttcatagaacacactttcttttggaatgtatttgattgataagaaagtttaaacattgttttcacctcaatgtagaaatacagtggttttgtttttttttttcttttagtgctgacaaaataaaatactcatttttgcataaaaaggttcctaatccttttgcagaataagttttgtttactctttataccaaaattcagtgaaggcattctacaagttttgagttagcattacattttaatatttactattgctacattgtataattgagtttgaaataaaacccagcttatgacaatgcattccctgtgcaagaaactgtttggctttcaaattacccaggcattgaaaatgaatgataaaaagttgctgtgtaagggaaatacagcctaaattgtttttgaaagccagaaatgatacaaagttcagtcatgccaaagtgaaatactttctagtgccagctttaacttaaatcatacgttttaaaaggacagatacagaaaattataggaaacaggcttaaattttgctccatatttaatgtagacgtttatagaagtttcccttaatttgtaattgcattcaaccgagaatttctcataaaagactaatttctgtgtaaagatattacgggctgggtgtggtggctcatgtctgtaatcccagcactctgggaggttgaggcaggcagattgcttgaactcaagagtttgagaccagcctgggcaacatggcgaaaacccatctctactaaaaatacaaaaaattagccgggtgtagtggtgcatctgtagtcccagctacttgagaggctgaggtgggaggatcctttgagtctcgaggcagaggttgcagtgagcctagagcgtgccactgcacgccagcctgagcaacagagcaaggctccatctaaagaaaaaaaaaaaaagttacttaaacttgtaactattaaatggcagtctcaaaattattgcatcaatttaagattcatagtagtttaagagcacatatgcttatctaaggtgaggcaaatagttctcttgctttacgagctacctttagacttacccacggcccagtctggtgcaagattttgcctgggggttataaataagggtgaatcaggaggctttgtacctatttctggtactctgacctgacatcactagttcaaagaactaaaaaattaggttatttccaggactgagctaagaaggccagagtgtgaagtagtagctgtttttgaaacaaatagatcagctcctggctttggggttagtgattaaatcaacaaatatttccctttctgtatttccttcctttcattttctttggctgccctaaaattttttgtaagaaaaaaacctgttaggatcttctctttgcctcacattttaggtgttataaaggaaattgattatgcaggaggctgagatgagaggatcacttgagcctaagagtttgaatccagtctggacaacatagcaagacccatctcttaaaaaaaaagaaagtgattaggaaacactggcttttttttgtttttctgtgtaataatgtaatgaaggcaattttcctatcagagcaaattgccagattttaaaaattccagttttactcttaaatttctataaaaccacaagatgttttaatatttcaataacttctaagaaatacttcaaaattgaattttgaaaatcattactaaataactaaatctattatatatactttatgtaacaaaaatatatatagtttgtgtgacaaaatatagagctgatgaaaaataaaaaa

SEQ ID NO: 439622 - DNA, 424 bp, Homo sapiens
cagagttggggagtggggaggggactgagccggccggagggccccccgcacccccgctcccacccaccccgggactgataatgtgaagttcctcattttgcacaagtggcactagccccagggccaacccttccttcctcagtcaccaagggcggggagttctggagtcggaaggcgaagagcctaccaccaggtctcccactcccgcggtgccctcccttcccttccctgcggccccggaccatatttattgcatgcgccccggcggccccccatcccgagcccaggctgggctgggctggaacgcggtctctttagctccctcctcttcgtttgtatatttcctaccttgtacacaggctcttccagagccgcttccattttctatactcgaaccaaacagcaataaagcagtaaccaagga

SEQ ID NO: 439623 - DNA, 3927 bp, Homo sapiens
accgccttcgccgcggaccttcagctgccgcggtcgctccgagcggcgggccgcagaggttcaagcgattctcctgcttcagcctccggagtagctgggattacaggcacgtgccaacacacccagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccatccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaacgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccctccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacggtataaaagcagtgcaaataaacacctaaccttctgcaaaaaaaaaagcttt

SEQ ID NO: 439624 - DNA, 3884 bp, Homo sapiens
accgccttcgccgcggaccttcagctgccgcggtcgctccgagcggcgggccgcagaggttcaagcgattctcctgcttcagcctccggagtagctgggattacaggcacgtgccaacacacccagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccatccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaacgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctccagtgaaggctgcccagagagaatgtcacagatgaggctgcccctgccccctccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacggtataaaagcagtgcaaataaacacctaaccttctgcaaaaaaaaaagcttt

SEQ ID NO: 439625 - DNA, 3826 bp, Homo sapiens
accgccttcgccgcggaccttcagctgccgcggtcgctccgagcggcgggccgcagaggttcaagcgattctcctgcttcagcctccggagtagctgggattacaggcacgtgccaacacacccagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccatccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaacgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacaaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctccagtgaaggctgcccagagagaatgtcacagatgaggctgcccctgccccctccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacggtataaaagcagtgcaaataaacacctaaccttctgcaaaaaaaaaagcttt

SEQ ID NO: 439626 - DNA, 3830 bp, Homo sapiens
accgccttcgccgcggaccttcagctgccgcggtcgctccgagcggcgggccgcagaggttcaagcgattctcctgcttcagcctccggagtagctgggattacaggcacgtgccaacacacccagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccatccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaacgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaactccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctccagtgaaggctgcccagagagaatgtcacagatgaggctgcccctgccccctccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacggtataaaagcagtgcaaataaacacctaaccttctgcaaaaaaaaaagcttt

SEQ ID NO: 439627 - DNA, 3786 bp, Homo sapiens
accgccttcgccgcggaccttcagctgccgcggtcgctccgagcggcgggccgcagagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgcccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccatccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaacgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccctccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacggtataaaagcagtgcaaataaacacctaaccttctgcaaaaaaaaaagcttt

SEQ ID NO: 439628 - DNA, 3873 bp, Homo sapiens
accgccttcgccgcggaccttcagctgccgcggtcgctccgagcggcgggccgcagaggttcaagcgattctcctgcttcagcctccggagtagctgggattacaggcacgtgccaacacacccagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccatccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggagatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaacgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccctccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacggtataaaagcagtgcaaataaacacctaaccttctgcaaaaaaaaaagcttt

SEQ ID NO: 439629 - DNA, 2947 bp, Homo sapiens
accgccttcgccgcggaccttcagctgccgcggtcgctccgagcggcgggccgcagaggttcaagcgattctcctgcttcagcctccggagtagctgggattacaggcacgtgccaacacacccagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccatccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaacgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaatcaggcagtcggcctggagtctgtgcctggtcctttgcccggtggtgggaggatggagggattgggctgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacggtataaaagcagtgcaaataaacacctaaccttctgcaaaaaaaaaagcttt

SEQ ID NO: 439630 - DNA, 1192 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctcgacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439631 - DNA, 2924 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439632 - DNA, 826 bp, Homo sapiens
agggcatagtccctctctgaggtaaggcaagagagaggttgtcccagcacaaggccttcctccctgcacctctctcctgacagctgggcatgggctgaggagaggtcttgcctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaaaaaaaaaaacaaaaaaaaaacaaaaaacaaaaaaaaaaaaaaaaaaaaaaaaagagaaaaagaaaaaaaaaaagaaaaaagaaagaaaaaccaaaacaaaaaagaaaaaagtaaagagatagaaccacaggaagcaaacagaggggaccgacgcagcaagcataaagaaagagcaacagagcaataggacaacagaagaagaagtgaaggagccctacacatgaaataagatcagcagcagaaagacgcacaccaaaaaagcaagaagcacaaagaaagagaaagacaatggcgccaaccacaggcgcacgaaagcgcacaaccgagatgaagaagggtgaggaaaattaacggtg

SEQ ID NO: 439633 - DNA, 743 bp, Homo sapiens
gagtgtgtgtggatggatgtgtgttgagagagagaatggatgtgtgtgtgtttacgaataaacttggaggggagggggcaacaggggtgggttttcgggctgagaaatgggaacactgtggggctgctgcaagcaggacttgggccttaaacattccaggagagtgttctcgggagtagccccgggaaggactttaacagaggttgggaattacatctctggcacagttttgcaagcagagggggagcttagttaaaggagcaaagaatgcaagtggaagatgccagcatctcggtctggaaaggatttattaactagttgaagagggctggtggattaaaacactcagcaccctaagaagcttgggagattcgattattatgttgcgctttagacaggagggcaggagaaagggcgttcttttctcgatttcttagaagagtctccggttacttttctgtggtgagaacgggtacgatccatcttttatcctgaatcatgtatgtttgtacatacatataatatgtttatattatatgtgtttatatatgtaaacactattgatgaggtgactgtgttctggcgtgtgatacgtgagttaagtaggtgctttgtataaccttgcggagtgtttaacgaaggtgttttgatgatagagcctagtatggactcttaggtggggagtggaaactagaaggttttaggactctatttgggtatctagattagagagcgttataatg

SEQ ID NO: 439634 - DNA, 1149 bp, Homo sapiens
aaataaccgggagacaagctttcggaggcttttgactgactggatgtgggaatgttgtggaagacttctggcctgccatttcctgagaacgggactgctgagagaggagctgggaggagcactgcaaatttcactttggacacgtgagagcctggcagagagcaggtgtgtgatacacgtcgtcaggtgactgaccgaggaattcagggcaaacagatcatctcaatttgccttgctgatgtgccagctgggattacgctgatggatgaagctcttcagagctatgggcaatatctacatatttgattgtcaagaaacttcgtgtggaaatagcttcaaacttacacaaattgcaagaataaaaaatagtataaggatattcgtacacactctctttactcagattcacctgttaatattttgctccatttgctctctatgtgtgcagagtatgtttttgttctgaaccatttgagaagttgcatctatcctggtcctctacttctcaatacttcagtgtgtattacctaagaattggaattaatcagttatcactgatactttaacctactgtccatattccacctttgtcattttacccaataacgtctttttaaaaaaagttttttgaggtttcattgacatacaattgatatcaatatgtgcaaagaactgcatataaagtgtacaatttgataagttttgacatatatgtgtgtgtgtgtatatatatatatatatatatacctgtaaaagtatcaccacaatcaagataataaacatatccacccttctagaagcttcctaatgcccctgtgtagtaactaccctactgcccttctctgcctccatccccaggcaacaactgatctgctttctgtaatatagattagtttctattttcggcagttttatgtcaatggaatcacagtgtatgtgctcttttttgtttttcccaaaaagacccatattgtgtaattatttggagattgtgttgtgtatgtcagtggtttattcagttttattgctgaatattattccattctatgagtaaaccacaatttgtttatctgtatttccctgttgatgggcctttgggttatttccagttttgagtgattatgaataaagttaccatcaacactcctg

SEQ ID NO: 439635 - DNA, 441 bp, Homo sapiens
aaataaccgggagacaagctttcggaggcttttgactgactggatgtgggaatgttgtggaagacttctggcctgccatttcctgagaacgggactgctgagagaggagctgggaggagcactgcaaatttcactttggacacgtgagagtggcagcatggagaggtggggcctttaagaggtgattggatcatgaaggctctattcccactaatgaatggattcatcatgggagaactggcggctttataaaagaggaagagagacctgcgctagcaccttagcacgctcagtccccctgccatgtcatgccctgaacccctcaggactctgcagagagttcctaccatcaagagggctctcaccaaatgcagcccctcaactttggacttctcagcctccagagctgtaagaaataaattccctttccttataaattac

SEQ ID NO: 439636 - DNA, 499 bp, Homo sapiens
ctgggccagcgctggggatcgggcctggggcctggattgcgacccgcggcgggccgcggctcctagccgagacggggcgggcgggaaccaggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggagaaggtgttgagctggcgagttcgcggaggctactattcaggaaatcttatccagatgagtacactggaagctacacctctccattactctgtccaggtcccttacaagttgttacgaggagcaaatgaaacaaggattttgaaaagtatccagggccgtgtacacaggaaacaataacatcgatgttgctctacgtgccttaaaagcacagaaacaa

SEQ ID NO: 439637 - DNA, 3186 bp, Homo sapiens
gagtgtgtgtggatggatgtgtgttgagagagagaatggatgtgtgtgtgtttacgaataaacttggaggggagggggcaacaggggtgggttttcgggctgagaaatgggaacactgtggggctgctgcaagcaggacttgggccttaaacattccaggagagtgttctcgggagtagccccgggaaggactttaacagaggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggaggtaacggacccctgagaggggcactgaagtctgcagtggggggggaggggcctggacacaccccttcccccccagactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439638 - DNA, 2841 bp, Homo sapiens
gcccttcttggggaagtcagctacccagcagcctgtagtcctcggctacccaccctcaccgcctggggtcccatggtgagacagctgggtgggcatcaggcttctgcagagggccaggccggagggagctgggcgagggagtggggctggctcctggcttgcaccggcctcgtggaatccaggcctcagacctgatcgctggcgaaactggctctgtgcgctggagcccctggtcttctgcgtctgtcctcctcccggccagactttactcctggctcagcgacaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439639 - DNA, 2630 bp, Homo sapiens
gcccttcttggggaagtcagctacccagcagcctgtagtcctcggctacccaccctcaccgcctggggtcccatggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439640 - DNA, 2900 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439641 - DNA, 3280 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaaaaaaaaaaacaaaaaaaaaacaaaaaacaaaaaaaaaaaaaaaaaaaaaaaaagagaaaaagaaaaaaaaaaagaaaaaagaaagaaaaaccaaaacaaaaaagaaaaaagtaaagagatagaaccacaggaagcaaacagaggggaccgacgcagcaagcataaagaaagagcaacagagcaataggacaacagaagaagaagtgaaggagccctacacatgaaataagatcagcagcagaaagacgcacaccaaaaaagcaagaagcacaaagaaagagaaagacaatggcgccaaccacaggcgcacgaaagcgcacaaccgagatgaagaagggtgaggaaaattaacggtg

SEQ ID NO: 439642 - DNA, 2720 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtcactgctccacctggtcactgctccacctcatgctgagaggagcctgtgtgtcaataccccaggg

SEQ ID NO: 439643 - DNA, 2558 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439644 - DNA, 2365 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439645 - DNA, 1367 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439646 - DNA, 979 bp, Homo sapiens
gcccttcttggggaagtcagctacccagcagcctgtagtcctcggctacccaccctcaccgcctggggtcccatggtgagacagctgggtgggcatcaggcttctgcagagggccaggccggagggagctgggcgagggagtggggctggctcctggcttgcaccggcctcgtggaatccaggcctcagacctgatcgctggcgaaactggctctgtgcgctggagcccctggtcttctgcgtctgtcctcctcccggccagactttactcctggctcagcgacaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439647 - DNA, 1778 bp, Homo sapiens
gagtgtgtgtggatggatgtgtgttgagagagagaatggatgtgtgtgtgtttacgaataaacttggaggggagggggcaacaggggtgggttttcgggctgagaaatgggaacactgtggggctgctgcaagcaggacttgggccttaaacattccaggagagtgttctcgggagtagccccgggaaggactttaacagaggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggaggtaacggacccctgagaggggcactgaagtctgcagtggggggggaggggcctggacacaccccttcccccccagactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtaaggctcctgtctcatttcccacttaatgtcttgctgtgcctgtgcagaaggtgttgagctggcgagttcgcggaggctactattcaggaaatcttatccagatgagtacactggaagctacacctctccattactctgtccagagcctggcagagagcaggtgtgtgatacacgtcgtcaggtgactgaccgaggaattcagggcaaacagatcatctcaatttgccttgctgatgtgccagctgggattacgctgatggatgaagctcttcagagctatgggcaatatctacatatttgattgtcaagaaacttcgtgtggaaatagcttcaaacttacacaaattgcaagaataaaaaatagtataaggatattcgtacacactctctttactcagattcacctgttaatattttgctccatttgctctctatgtgtgcagagtatgtttttgttctgaaccatttgagaagttgcatctatcctggtcctctacttctcaatacttcagtgtgtattacctaagaattggaattaatcagttatcactgatactttaacctactgtccatattccacctttgtcattttacccaataacgtctttttaaaaaaagttttttgaggtttcattgacatacaattgatatcaatatgtgcaaagaactgcatataaagtgtacaatttgataagttttgacatatatgtgtgtgtgtgtatatatatatatatatatatacctgtaaaagtatcaccacaatcaagataataaacatatccacccttctagaagcttcctaatgcccctgtgtagtaactaccctactgcccttctctgcctccatccccaggcaacaactgatctgctttctgtaatatagattagtttctattttcggcagttttatgtcaatggaatcacagtgtatgtgctcttttttgtttttcccaaaaagacccatattgtgtaattatttggagattgtgttgtgtatgtcagtggtttattcagttttattgctgaatattattccattctatgagtaaaccacaatttgtttatctgtatttccctgttgatgggcctttgggttatttccagttttgagtgattatgaataaagttaccatcaacactcctg

SEQ ID NO: 439648 - DNA, 793 bp, Homo sapiens
gagtgtgtgtggatggatgtgtgttgagagagagaatggatgtgtgtgtgtttacgaataaacttggaggggagggggcaacaggggtgggttttcgggctgagaaatgggaacactgtggggctgctgcaagcaggacttgggccttaaacattccaggagagtgttctcgggagtagccccgggaaggactttaacagaggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggaggtaacggacccctgagaggggcactgaagtctgcagtggggggggaggggcctggacacaccccttcccccccagactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtaaggctcctgtctcatgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439649 - DNA, 1370 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctgagcctggcagagagcaggtgtgtgatacacgtcgtcaggtgactgaccgaggaattcagggcaaacagatcatctcaatttgccttgctgatgtgccagctgggattacgctgatggatgaagctcttcagagctatgggcaatatctacatatttgattgtcaagaaacttcgtgtggaaatagcttcaaacttacacaaattgcaagaataaaaaatagtataaggatattcgtacacactctctttactcagattcacctgttaatattttgctccatttgctctctatgtgtgcagagtatgtttttgttctgaaccatttgagaagttgcatctatcctggtcctctacttctcaatacttcagtgtgtattacctaagaattggaattaatcagttatcactgatactttaacctactgtccatattccacctttgtcattttacccaataacgtctttttaaaaaaagttttttgaggtttcattgacatacaattgatatcaatatgtgcaaagaactgcatataaagtgtacaatttgataagttttgacatatatgtgtgtgtgtgtatatatatatatatatatatacctgtaaaagtatcaccacaatcaagataataaacatatccacccttctagaagcttcctaatgcccctgtgtagtaactaccctactgcccttctctgcctccatccccaggcaacaactgatctgctttctgtaatatagattagtttctattttcggcagttttatgtcaatggaatcacagtgtatgtgctcttttttgtttttcccaaaaagacccatattgtgtaattatttggagattgtgttgtgtatgtcagtggtttattcagttttattgctgaatattattccattctatgagtaaaccacaatttgtttatctgtatttccctgttgatgggcctttgggttatttccagttttgagtgattatgaataaagttaccatcaacactcctg

SEQ ID NO: 439650 - DNA, 3075 bp, Homo sapiens
ctgggccagcgctggggatcgggcctggggcctggattgcgacccgcggcgggccgcggctcctagccgagacggggcgggcgggaaccaggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggaggtaacggacccctgagaggggcactgaagtctgcagtggggggggaggggcctggacacaccccttcccccccagactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439651 - DNA, 2875 bp, Homo sapiens
ctgggccagcgctggggatcgggcctggggcctggattgcgacccgcggcgggccgcggctcctagccgagacggggcgggcgggaaccaggttaacacagaaatctgcctcctgggccatgccgcttctaaggcctgtttcttctcatgagccccaactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439652 - DNA, 2962 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctgagcctggcagagagcaggtgtgtgatacacgtcgtcaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439653 - DNA, 3106 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaaaaaaaaaaccacgcacaaaaaaactttgtgggcccccgggccccgaaaaagttcttaacacccttcctggggccgggcccacacggcaggcaccgggcccagcgggtcccgggggacccgggccggacggctgggtctccccataaagcccggggcaccggcgtttggcacccaagggtcgg

SEQ ID NO: 439654 - DNA, 3310 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaaaaaaaaaaaacggcacgaggtaatatttcctgtggttgggaatcctagaatgcctgatctattttatctgttcaggtagttttgttattgtaccctcttttgggtcatattctagtatttctcacagggggtatgagaaacagaaagctatatgtagcagctggtcttgagaagtagaagcatcttaactgtcataagagcatagattttttgtttttcacaacagctggaataagttcctgcattataagtataaagggaaccgagatttaatttggagatcatcactgttaaaacgataccagacatttgtcacagtgtcttatttggggaaagtttgctaatatacattttgtctgtgaaaatatagtaaattttaaaatact

SEQ ID NO: 439655 - DNA, 2487 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439656 - DNA, 2324 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcacctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439657 - DNA, 1062 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaa

SEQ ID NO: 439658 - DNA, 646 bp, Homo sapiens
tggtgggcgcttataatcccagctactcgggaggctgaggcagaagaatcgcttgaacccaggaggcggaagttgcagtaagccgagatcgccccactgtactccagcctgggcaacagagtgagactcttttttgagagtctgtctcaaaacaaacaaaaaaaattaattagactaaaaagtcctacaaaattttgaaggtagctgatgagtacacaagagttcatatattttttgtaggcttgaacatttctgtaagtttcaggaaactaagtcctataagttgaagaaaaatatttttaaaattctaacatctatagctgattatgtttatcaacccagtccataatctaaccctgttgttcttcttgctgaagtgaatactgtaaaatcttttcttggctcaagaattttctttgggcattgacatcatgttgactggagggttcagaagttaagaagctgggtgggactggtctgaaggcagtgagtcaactgaattgattattcacagtcagttacgcatccaactctttattctactcttccccccttctcactactgcatttgacacttgtgggtttttttcaattactcttttttttggagacagggtctcgccctgtcacccaggctggagtacag

SEQ ID NO: 439659 - DNA, 705 bp, Homo sapiens
agcggactacatttcccagggggctgcgggactgccgggaggagtgggggcggtgcctcacgtctggtacagtcatcacaagcctgttcggcgggactgtgatggccagagagatgacgatcttaggatcggctgttttgactctcctgttggccggctatttggcacaacagtatttaccattgcctactcctaaagtgattggtattgatcttggcaccacctattgttctgttggggtgttttttcctggcacaggaaaagtaaaggtgattccagatgaaaatgggcatatcagcatacccagcatggtgtcttttactgacaatgatgtatatgtgggatatgaaagcgtagagctggcagattcaaatcctcaaaacacaatatatgatgccaaaagattcataggcaagatttttaccgcagaagagttggaggctgaaattggcagatacccatttaaggttttaaacaaaaatggaatggttgagttttctgtgacaagtaatgagaccatcacagtgtccccagaatatgttggctctcgactattgttgaagttaaaggaaatggcagaggcatatcttggaatgccagttgccaatgctgtcatttctgtaccagcagaatttgatctaaaacagagaaattcaacaattgaagctgctaaccttgcaggtaacagtacccttgactgagatg

SEQ ID NO: 439660 - DNA, 3547 bp, Homo sapiens
  misc_feature (3485)..(3485): n is a, c, g, or t
  misc_feature (3487)..(3487): n is a, c, g, or t
  misc_feature (3493)..(3493): n is a, c, g, or t
  misc_feature (3495)..(3495): n is a, c, g, or t
  misc_feature (3505)..(3505): n is a, c, g, or t
  misc_feature (3509)..(3509): n is a, c, g, or t
agcggactacatttcccagggggctgcgggactgccgggaggagtgggggcggtgcctcacgtctggtacagtcatcacaagcctgttcggcgggactgtgatggccagagagatgacgatcttaggatcggctgttttgactctcctgttggccggctatttggcacaacagtatttaccattgcctactcctaaagtgattggtattgatcttggcaccacctattgttctgttggggtgttttttcctggcacaggaaaagtaaaggtgattccagatgaaaatgggcatatcagcatacccagcatggtgtcttttactgacaatgatgtatatgtgggatatgaaagcgtagagctggcagattcaaatcctcaaaacacaatatatgatgccaaaagattcataggcaagatttttaccgcagaagagttggaggctgaaattggcagatacccatttaaggttttaaacaaaaatggaatggttgagttttctgtgacaagtaatgagaccatcacagtgtccccagaatatgttggctctcgactattgttgaagttaaaggaaatggcagaggcatatcttggaatgccagttgccaatgctgtcatttctgtaccagcagaatttgatctaaaacagagaaattcaacaattgaagctgctaaccttgcaggactgaagattttgagggtaataaatgaacccacagcagcagctatggcctatggtctccacaaggctgacgtcttccacgtcttggtgatagacttgggcggaggaactctagatgtgtctttactgaataaacaaggagggatgtttctaacccgagcaatgtctggaaacaataaacttggaggacaggacttcaatcagagattgcttcagtacttatataaacagatctatcaaacatatggcttcgtgccctctaggaaagaggaaatccacagattgagacaagctgtggaaatggtcaaattaaatctgactcttcatcaatctgctcagttgtcagtattactaacggtggaggagcaggacaggaaggaacctcacagtagtgacactgaactgccaaaagacaaactttcctcagcagatgaccatcgcgtgaacagtgggtttggacgtggcctttctgataagaaaagtggagaaagtcaggttttatttgaaacagaaatatcacggaaactctttgatacccttaatgaagacctctttcagaaaatactggtacccattcagcaagtattgaaagaaggccacctggaaaagactgagattgatgaggtggttttagttgggggctccactcgtattcctcggatccgtcaagtcattcaagagttctttggaaaagatcccaacacatctgtagaccctgacctagcagtagtaacgggagtggctatccaagcagggattgatggaggctcttggcctctccaagtcagtgctttagaaattcccaataagcatttacaaaaaaccaacttcaactgaattctgcagaaataatggttatttgtgaacttgtctgatgatctcttcccatttatcagattaccttttccacaaaagaaagtctctaaaatatcacagatttacctagagggcaacatttagatacaggaaaattttacatagtgttttgtcttaggattagacgtgaccagattgatcctgtttgattttggagagatcctattctaacaaatactctaaaatgataaaattgaggtacaactctcttaaaagagtatggataactatattttctggattctggaggttgataaccatatgcacttaacattatattctataaacattaagtagtgccagttatgagattcccagttcttactaaattgtattagcaggagctggtaattacttgtattatcacatgtaactaataatttgaactatacttgaaggaccgtgttgatgtcaggtatttacagtggttggaagatagcagtattattagcataagctgcatacgtaatattcagtaactgccatattatataacaaatttacattcacaaattcagtatcctgttaagtgtcatattcttgtaatctgcattctccaggagttttatgtgtttaatagatgaatttattttatttctaaaggtattcaaatgtttcagcaccatatagtagaaatacccaattatattctagttcctttatgtcctgtacatcattctctgcttggatttccattattctgtttggttagagaataaaattggtaattgcatttgaagaatgtgttaatgtcataataaagccatgattgctatcttatttttgttatccaagacctttgcaaacattggcaaatagcatcaattacctactgtatttgtttctttgtttatattttcagtaagccctggggaatatagcatggaattgagctactaaatggttttggttccgttttacggagatttttcctcatatttagttttgaatgaggaaaatgtgctcaattataaaagctgtgttattgttttctattattatttttaaataatcacacttggactcttttcaaacattaggttagtttgtaatgaaagcaaaaaatttgtgaatactggaagtaacgtggaaatctaatgtggaagccattgtggcaaggtttctacaaatcggcatttggagcagagttgtttgttttgttgttgtttcctttaagaaaaaccacagggaccaagaaagaaaatataacagtttgatttctgtcatacccattgtatttgaagatatatggatacagattatatatatatatacatattttccttaatagaggaatgcttcatattattcaaaaattatatcctgatcacctttttttgttttttattgtaaagtatctctgctttatccattgctgaattcgataggatgttgaaatgctggtcaccaaaaaaggaaactgagcaaattcatttcaacaacatcaaaacttcagcttctcatagtaaaaagctgaatgttactaatatttttcatatctaaaaaaaaattcttagcaatgaaatggctgttaaaacacaaatttcaatcaaatacttttgtgtatagaaaatatgtatagtaggtagatagaaaagtataaaatgtttgttgaagtatcttattttagaatgaatggagaaatgccaaagatgaatccttcactgcattatgaaaatatttcacatgttctcttggactttatataaatctgtaatagattttagaattgaaaaattctttgtgaaggtcttctaaaagtgttccaatttatctcaaaatctccatatataggatcagcttaaaacataaagaaaaccttgaatttctcaaatgtttgagatgttcaagacaggtctaacgggatgtttgggacactgcacaaagggggggcacttcagtcgaggggagtaaaaaccttgcgcaaananacgggngngggagggaancttnatagccaaaaaggggccacattgggggaacaaacacga

SEQ ID NO: 439661 - DNA, 4050 bp, Homo sapiens
agcggactacatttcccagggggctgcgggactgccgggaggagtgggggcggtgcctcacgtctggtacagtcatcacaagcctgttcggcgggactgtgatggccagagagatgacgatcttaggatcggctgttttgactctcctgttggccggctatttggcacaacagtatttaccattgcctactcctaaagtgattggtattgatcttggcaccacctattgttctgttggggtgttttttcctggcacaggaaaagtaaaggtgattccagatgaaaatgggcatatcagcatacccagcatggtgtcttttactgacaatgatgtatatgtgggatatgaaagcgtagagctggcagattcaaatcctcaaaacacaatatatgatgccaaaagattcataggcaagatttttaccgcagaagagttggaggctgaaattggcagatacccatttaagtaaaggggtttttgtttaagagaagccgaaaataaaaaatttggggaaaaattgtggggttgaagtttttctgtgacaagtaatgagaccatcacagtgtccccagaatatgttggctctcgactattgttgaagttaaaggaaatggcagaggcatatcttggaatgccagttgccaatgctgtcatttctgtaccagcagaatttgatctaaaacagagaaattcaacaattgaagctgctaaccttgcaggactgaagattttgagggtaataaatgaacccacagcagcagctatggcctatggtctccacaaggctgacgtcttccacgtcttggtgatagacttgggcggaggaactctagatgtgtctttactgaataaacaaggagggatgtttctaacccgagcaatgtctggaaacaataaacttggaggacaggacttcaatcagagattgcttcagtacttatataaacagatctatcaaacatatggcttcgtgccctctaggaaagaggaaatccacagattgagacaagctgtggaaatggtcaaattaaatctgactcttcatcaatctgctcagttgtcagtattactaacggtggaggagcaggacaggaaggaacctcacagtagtgacactgaactgccaaaagacaaactttcctcagcagatgaccatcgcgtgaacagtgggtttggacgtggcctttctgataagaaaagtggagaaagtcaggttttatttgaaacagaaatatcacggaaactctttgatacccttaatgaagacctctttcagaaaatactggtacccattcagcaagtattgaaagaaggccacctggaaaagactgagattgatgaggtggttttagttgggggctccactcgtattcctcggatccgtcaagtcattcaagagttctttggaaaagatcccaacacatctgtagaccctgacctagcagtagtaacgggagtggctatccaagcagggattgatggaggctcttggcctctccaagtcagtgctttagaaattcccaataagcatttacaaaaaaccaacttcaactgaattctgcagaaataatggttatttgtgaacttgtctgatgatctcttcccatttatcagattaccttttccacaaaagaaagtctctaaaatatcacagatttacctagagggcaacatttagatacaggaaaattttacatagtgttttgtcttaggattagacgtgaccagattgatcctgtttgattttggagagatcctattctaacaaatactctaaaatgataaaattgaggtacaactctcttaaaagagtatggataactatattttctggattctggaggttgataaccatatgcacttaacattatattctataaacattaagtagtgccagttatgagattcccagttcttactaaattgtattagcaggagctggtaattacttgtattatcacatgtaactaataatttgaactatacttgaaggaccgtgttgatgtcaggtatttacagtggttggaagatagcagtattattagcataagctgcatacgtaatattcagtaactgccatattatataacaaatttacattcacaaattcagtatcctgttaagtgtcatattcttgtaatctgcattctccaggagttttatgtgtttaatagatgaatttattttatttctaaaggtattcaaatgtttcagcaccatatagtagaaatacccaattatattctagttcctttatgtcctgtacatcattctctgcttggatttccattattctgtttggttagagaataaaattggtaattgcatttgaagaatgtgttaatgtcataataaagccatgattgctatcttatttttgttatccaagacctttgcaaacattggcaaatagcatcaattacctactgtatttgtttctttgtttatattttcagtaagccctggggaatatagcatggaattgagctactaaatggttttggttccgttttacggagatttttcctcatatttagttttgaatgaggaaaatgtgctcaattataaaagctgtgttattgttttctattattatttttaaataatcacacttggactcttttcaaacattaggttagtttgtaatgaaagcaaaaaatttgtgaatactggaagtaacgtggaaatctaatgtggaagccattgtggcaaggtttctacaaatcggcatttggagcagagttgtttgttttgttgttgtttcctttaagaaaaaccacagggaccaagaaagaaaatataacagtttgatttctgtcatacccattgtatttgaagatatatggatacagattatatatatatatacatattttccttaatagaggaatgcttcatattattcaaaaattatatcctgatcacctttttttgttttttattgtaaagtatctctgctttatccattgctgaattcgataggatgttgaaatgctggtcaccaaaaaaggaaactgagcaaattcatttcaacaacatcaaaacttcagcttctcatagtaaaaagctgaatgttactaatatttttcatatctaaaaaaaaattcttagcaatgaaatggctgttaaaacacaaatttcaatcaaatacttttgtgtatagaaaatatgtatagtaggtagatagaaaagtataaaatgtttgttgaagtatcttattttagaatgaatggagaaatgccaaagatgaatccttcactgcattatgaaaatatttcacatgttctcttggactttatataaatctgtaatagattttagaattgaaaaattctttgtgaaggtcttctaaaagtgttccaatttatctcaaaatctccatatataggatcagcttaaaacataaagaaaaccttgaatttctcaaatgtttgagatgttcaagacagtctcttaatccgttaatgcttttggaaacaattgacaaaatagggcaggcagctcatctcatgtcctgaagttggaatttaaataattcctatttgcaaattagaatgacagtgttggaatttggaggcagtagttgagcatattctctagtatatagctacacctttaataaaatgaaggaatgtcttcaatcatattttagtgggctatttataaatagtcttgaagtcaatttagtttatttatttaaaagataatgcatcctgaaagggatcatttatgaataacaatctgaagtcttttcataaaaaaaattaataaactttagttgtacatttagccagtgttatttgaagtatgtaacttttaaaatattaagtgtcttgtatgattagaatatgtgaatgagtaacttattttgtatcaggaatgttttggtactgtgttttcactcaaaccactgacttaacagatactgctgtgtataacatgtactaaatattacagttattgtgcataacagattgttcctcttatatttgtgtgtatacaggcaattcatgttttaatgtaaataaataccattttgcagtttgttt

SEQ ID NO: 439662 - DNA, 4011 bp, Homo sapiens
agcggactacatttcccagggggctgcgggactgccgggaggagtgggggcggtgcctcacgtctggtacagtcatcacaagcctgttcggcgggactgtgatggccagagagatgacgatcttaggatcggctgttttgactctcctgttggccggctatttggcacaacagtatttaccattgcctactcctaaagtgattggtattgatcttggcaccacctattgttctgttggggtgttttttcctggcacaggaaaagtaaaggtgattccagatgaaaatgggcatatcagcatacccagcatggtgtcttttactgacaatgatgtatatgtgggatatgaaagcgtagagctggcagattcaaatcctcaaaacacaatatatgatgccaaaagattcataggcaagatttttaccgcagaagagttggaggctgaaattggcagatacccatttaaggttttaaacaaaaatggaatggttgagttttctgtgacaagtaatgagaccatcacagtgtccccagaatatgttggctctcgactattgttgaagttaaaggaaatggcagaggcatatcttggaatgccagttgccaatgctgtcatttctgtaccagcagaatttgatctaaaacagagaaattcaacaattgaagctgctaaccttgcaggactgaagattttgagggtaataaatgaacccacagcagcagctatggcctatggtctccacaaggctgacgtcttccacgtcttggtgatagacttgggcggaggaactctagatgtgtctttactgaataaacaaggagggatgtttctaacccgagcaatgtctggaaacaataaacttggaggacaggacttcaatcagagattgcttcagtacttatataaacagatctatcaaacatatggcttcgtgccctctaggaaagaggaaatccacagattgagacaagctgtggaaatggtcaaattaaatctgactcttcatcaatctgctcagttgtcagtattactaacggtggaggagcaggacaggaaggaacctcacagtagtgacactgaactgccaaaagacaaactttcctcagcagatgaccatcgcgtgaacagtgggtttggacgtggcctttctgataagaaaagtggagaaagtcaggttttatttgaaacagaaatatcacggaaactctttgatacccttaatgaagacctctttcagaaaatactggtacccattcagcaagtattgaaagaaggccacctggaaaagactgagattgatgaggtggttttagttgggggctccactcgtattcctcggatccgtcaagtcattcaagagttctttggaaaagatcccaacacatctgtagaccctgacctagcagtagtaacgggagtggctatccaagcagggattgatggaggctcttggcctctccaagtcagtgctttagaaattcccaataagcatttacaaaaaaccaacttcaactgaattctgcagaaataatggttatttgtgaacttgtctgatgatctcttcccatttatcagattaccttttccacaaaagaaagtctctaaaatatcacagatttacctagagggcaacatttagatacaggaaaattttacatagtgttttgtcttaggattagacgtgaccagattgatcctgtttgattttggagagatcctattctaacaaatactctaaaatgataaaattgaggtacaactctcttaaaagagtatggataactatattttctggattctggaggttgataaccatatgcacttaacattatattctataaacattaagtagtgccagttatgagattcccagttcttactaaattgtattagcaggagctggtaattacttgtattatcacatgtaactaataatttgaactatacttgaaggaccgtgttgatgtcaggtatttacagtggttggaagatagcagtattattagcataagctgcatacgtaatattcagtaactgccatattatataacaaatttacattcacaaattcagtatcctgttaagtgtcatattcttgtaatctgcattctccaggagttttatgtgtttaatagatgaatttattttatttctaaaggtattcaaatgtttcagcaccatatagtagaaatacccaattatattctagttcctttatgtcctgtacatcattctctgcttggatttccattattctgtttggttagagaataaaattggtaattgcatttgaagaatgtgttaatgtcataataaagccatgattgctatcttatttttgttatccaagacctttgcaaacattggcaaatagcatcaattacctactgtatttgtttctttgtttatattttcagtaagccctggggaatatagcatggaattgagctactaaatggttttggttccgttttacggagatttttcctcatatttagttttgaatgaggaaaatgtgctcaattataaaagctgtgttattgttttctattattatttttaaataatcacacttggactcttttcaaacattaggttagtttgtaatgaaagcaaaaaatttgtgaatactggaagtaacgtggaaatctaatgtggaagccattgtggcaaggtttctacaaatcggcatttggagcagagttgtttgttttgttgttgtttcctttaagaaaaaccacagggaccaagaaagaaaatataacagtttgatttctgtcatacccattgtatttgaagatatatggatacagattatatatatatatacatattttccttaatagaggaatgcttcatattattcaaaaattatatcctgatcacctttttttgttttttattgtaaagtatctctgctttatccattgctgaattcgataggatgttgaaatgctggtcaccaaaaaaggaaactgagcaaattcatttcaacaacatcaaaacttcagcttctcatagtaaaaagctgaatgttactaatatttttcatatctaaaaaaaaattcttagcaatgaaatggctgttaaaacacaaatttcaatcaaatacttttgtgtatagaaaatatgtatagtaggtagatagaaaagtataaaatgtttgttgaagtatcttattttagaatgaatggagaaatgccaaagatgaatccttcactgcattatgaaaatatttcacatgttctcttggactttatataaatctgtaatagattttagaattgaaaaattctttgtgaaggtcttctaaaagtgttccaatttatctcaaaatctccatatataggatcagcttaaaacataaagaaaaccttgaatttctcaaatgtttgagatgttcaagacagtctcttaatccgttaatgcttttggaaacaattgacaaaatagggcaggcagctcatctcatgtcctgaagttggaatttaaataattcctatttgcaaattagaatgacagtgttggaatttggaggcagtagttgagcatattctctagtatatagctacacctttaataaaatgaaggaatgtcttcaatcatattttagtgggctatttataaatagtcttgaagtcaatttagtttatttatttaaaagataatgcatcctgaaagggatcatttatgaataacaatctgaagtcttttcataaaaaaaattaataaactttagttgtacatttagccagtgttatttgaagtatgtaacttttaaaatattaagtgtcttgtatgattagaatatgtgaatgagtaacttattttgtatcaggaatgttttggtactgtgttttcactcaaaccactgacttaacagatactgctgtgtataacatgtactaaatattacagttattgtgcataacagattgttcctcttatatttgtgtgtatacaggcaattcatgttttaatgtaaataaataccattttgcagtttgttt

SEQ ID NO: 439663 - DNA, 4099 bp, Homo sapiens
ttcccagaatgcaaagcgcggggcggggctaaagagatagcctgttttccctcaagtaggatcgcgggaccacaggtttgattataaacgccagtctctcgccacggcgctcctccccctcagtctcactggtcctgccggccgttgcgtggaagggggactcagtcgtcactggcagcggttgaatggaggctctttgccccgcgccctcacggatcggctgttttgactctcctgttggccggctatttggcacaacagtatttaccattgcctactcctaaagtgattggtattgatcttggcaccacctattgttctgttggggtgttttttcctggcacaggaaaagtaaaggtgattccagatgaaaatgggcatatcagcatacccagcatggtgtcttttactgacaatgatgtatatgtgggatatgaaagcgtagagctggcagattcaaatcctcaaaacacaatatatgatgccaaaagattcataggcaagatttttaccgcagaagagttggaggctgaaattggcagatacccatttaaggttttaaacaaaaatggaatggttgagttttctgtgacaagtaatgagaccatcacagtgtccccagaatatgttggctctcgactattgttgaagttaaaggaaatggcagaggcatatcttggaatgccagttgccaatgctgtcatttctgtaccagcagaatttgatctaaaacagagaaattcaacaattgaagctgctaaccttgcaggactgaagattttgagggtaataaatgaacccacagcagcagctatggcctatggtctccacaaggctgacgtcttccacgtcttggtgatagacttgggcggaggaactctagatgtgtctttactgaataaacaaggagggatgtttctaacccgagcaatgtctggaaacaataaacttggaggacaggacttcaatcagagattgcttcagtacttatataaacagatctatcaaacatatggcttcgtgccctctaggaaagaggaaatccacagattgagacaagctgtggaaatggtcaaattaaatctgactcttcatcaatctgctcagttgtcagtattactaacggtggaggagcaggacaggaaggaacctcacagtagtgacactgaactgccaaaagacaaactttcctcagcagatgaccatcgcgtgaacagtgggtttggacgtggcctttctgataagaaaagtggagaaagtcaggttttatttgaaacagaaatatcacggaaactctttgatacccttaatgaagacctctttcagaaaatactggtacccattcagcaagtattgaaagaaggccacctggaaaagactgagattgatgaggtggttttagttgggggctccactcgtattcctcggatccgtcaagtcattcaagagttctttggaaaagatcccaacacatctgtagaccctgacctagcagtagtaacgggagtggctatccaagcagggattgatggaggctcttggcctctccaagtcagtgctttagaaattcccaataagcatttacaaaaaaccaacttcaactgaattctgcagaaataatggttatttgtgaacttgtctgatgatctcttcccatttatcagattaccttttccacaaaagaaagtctctaaaatatcacagatttacctagagggcaacatttagatacaggaaaattttacatagtgttttgtcttaggattagacgtgaccagattgatcctgtttgattttggagagatcctattctaacaaatactctaaaatgataaaattgaggtacaactctcttaaaagagtatggataactatattttctggattctggaggttgataaccatatgcacttaacattatattctataaacattaagtagtgccagttatgagattcccagttcttactaaattgtattagcaggagctggtaattacttgtattatcacatgtaactaataatttgaactatacttgaaggaccgtgttgatgtcaggtatttacagtggttggaagatagcagtattattagcataagctgcatacgtaatattcagtaactgccatattatataacaaatttacattcacaaattcagtatcctgttaagtgtcatattcttgtaatctgcattctccaggagttttatgtgtttaatagatgaatttattttatttctaaaggtattcaaatgtttcagcaccatatagtagaaatacccaattatattctagttcctttatgtcctgtacatcattctctgcttggatttccattattctgtttggttagagaataaaattggtaattgcatttgaagaatgtgttaatgtcataataaagccatgattgctatcttatttttgttatccaagacctttgcaaacattggcaaatagcatcaattacctactgtatttgtttctttgtttatattttcagtaagccctggggaatatagcatggaattgagctactaaatggttttggttccgttttacggagatttttcctcatatttagttttgaatgaggaaaatgtgctcaattataaaagctgtgttattgttttctattattatttttaaataatcacacttggactcttttcaaacattaggttagtttgtaatgaaagcaaaaaatttgtgaatactggaagtaacgtggaaatctaatgtggaagccattgtggcaaggtttctacaaatcggcatttggagcagagttgtttgttttgttgttgtttcctttaagaaaaaccacagggaccaagaaagaaaatataacagtttgatttctgtcatacccattgtatttgaagatatatggatacagattatatatatatatacatattttccttaatagaggaatgcttcatattattcaaaaattatatcctgatcacctttttttgttttttattgtaaagtatctctgctttatccattgctgaattcgataggatgttgaaatgctggtcaccaaaaaaggaaactgagcaaattcatttcaacaacatcaaaacttcagcttctcatagtaaaaagctgaatgttactaatatttttcatatctaaaaaaaaattcttagcaatgaaatggctgttaaaacacaaatttcaatcaaatacttttgtgtatagaaaatatgtatagtaggtagatagaaaagtataaaatgtttgttgaagtatcttattttagaatgaatggagaaatgccaaagatgaatccttcactgcattatgaaaatatttcacatgttctcttggactttatataaatctgtaatagattttagaattgaaaaattctttgtgaaggtcttctaaaagtgttccaatttatctcaaaatctccatatataggatcagcttaaaacataaagaaaaccttgaatttctcaaatgtttgagatgttcaagacagtctcttaatccgttaatgcttttggaaacaattgacaaaatagggcaggcagctcatctcatgtcctgaagttggaatttaaataattcctatttgcaaattagaatgacagtgttggaatttggaggcagtagttgagcatattctctagtatatagctacacctttaataaaatgaaggaatgtcttcaatcatattttagtgggctatttataaatagtcttgaagtcaatttagtttatttatttaaaagataatgcatcctgaaagggatcatttatgaataacaatctgaagtcttttcataaaaaaaattaataaactttagttgtacatttagccagtgttatttgaagtatgtaacttttaaaatattaagtgtcttgtatgattagaatatgtgaatgagtaacttattttgtatcaggaatgttttggtactgtgttttcactcaaaccactgacttaacagatactgctgtgtataacatgtactaaatattacagttattgtgcataacagattgttcctcttatatttgtgtgtatacaggcaattcatgttttaatgtaaataaataccattttgcagtttgttt

SEQ ID NO: 439664 - DNA, 938 bp, Homo sapiens
agcggactacatttcccagggggctgcgggactgccgggaggagtgggggcggtgcctcacgtctggtacagtcatcacaagcctgttcggcgggactgtgatggccagagagatgacgatcttaggatcggctgttttgactctcctgttggccggctatttggcacaacagtatttaccattgcctactcctaaagtgattggtattgatcttggcaccacctattgttctgttggggtgttttttcctggcacaggaaaagtaaaggtgattccagatgaaaatgggcatatcagcatacccagcatggtgtcttttactgacaatgatgtatatgtgggatatgaaagcgtagagctggcagattcaaatcctcaaaacacaatatatgatgccaaaagattcataggcaagatttttaccgcagaagagttggaggctgaaattggcagatacccatttaaggttttaaacaaaaatggaatggttgagttttctgtgacaagtaatgagaccatcacagtgtccccagaatatgttggctctcgactattgttgaagttaaaggaaatggcagaggcatatcttggaatgccagttgccaatgctgtcatttctgtaccagcagaatttgatctaaaacagagaaattcaacaattgaagctgctaaccttgcaggactgaagattttgagggtaataaatgaacccacagcagcagctatggcctatggtctccacaaggctgacgtcttccacgtcttggtgatagacttgggcggaggaactctagatgtgtctttactgaataaacaaggagggatgtttctaacccgagcaatgtctggaaacaataaacttggaggacaggacttcaatcagagattgcttcagtacttatataaacagatcgggatcctctagttcacccgcacg

SEQ ID NO: 439665 - DNA, 467 bp, Homo sapiens
aaagttcagatttttaatttgagagggtttttatttcatggaggcagtgttaactaaaattaagcttagatttagctcctgtattattcataatatgagaaattttattaaaggcagactttggtaaaagtgccaacacacttacttgtatagaaaagacttcattctatgggatttatataagtaagtgctttctctatattcaaaatatttcataaggacctgtggtttttttccccttaaaaagcaactctaggccgggcacagtggctcatgcctgtaatccacctgccttggcctttcaaagtgtggggattataggcgcgagccaccgcacctggccaggcaaaatttcaagaataacccaacacctaagtaaaggcagcggatcctgcaaaactttaaaaagacttctactttcaaatgatccagcatcatacacatctaaaacaacacgactacaaaac

SEQ ID NO: 439666 - DNA, 2315 bp, Homo sapiens
aaagttcagatttttaatttgagagggtttttatttcatggaggcagtgttaactaaaattaagcttagatttagctcctgtattattcataatatgagaaattttattaaaggcagactttggtaaaagtgccaacacacttacttgtatagaaaagacttcattctatgggatttatataagtaagtgctttctctatattcaaaatatttcataaggacctgtggtttttttccccttaaaaagcaactctaggccgggcacagtggctcatgcctgtaatcccagcactttgggaggccaaggcaggtggatcacttgaggtcaggagttcgagaccagctggttaacatggtgaaaccccatctctactaaaaatacaaaaattagccaggtgtggtggcacgcgcctgtaatcccagctacatgggaggttgaggcaggagaatctcttgaacccaggaggtggaggttgcagtgagccgcaattacaccactgcactccagcctgggtgacacagcgagtctccatctccaaaaaaaattcaactcttggtcttgtttctcagcacttagtttattgttattagaatttagccatacagccaactttgacaaaatgggtcacagaacaagcatgtacatcaagaggaagttccatatcccccttgtaccatttctccttgggaactcatgctatgggctaccttaaaggtaaaactcatcttatggagtctttctgataggtcactaggtaaaactccttggatagggtgaaaatggatgcacactctattacatactctggtttatcataaggaattttccagaaagctaagctttatactaataagatattggttggtagtaggaacttcaaaaatgaatgagtttgccataactttaattttctggattagaaacacaaaacttgaaatgcaattatcaatattttgtaatatatattcctacagtttgggtagaaataaggaacatgtctgctagatctggtttatgaaaaagtgaaaaatattaaatacaccagagactcaaaccctttcaaggcacacaataactgttctggatttacctgacaaacctagttgagtagcattttgacagaaaatatcagactgaaagttcattcaaatgtacttaaatgtacaatacagtgttcaatagtttttattgcagtgatgtttttccaataatttaagtaattctcttcctagtataatacagttttcataaataatgtttacttgctttctttatattttcaaataaaattaaaatgctcgagcacttcctttcagaaagttataaaattaaaaataattattttaaatgctcattcaaatgtgtctgtatacttgctatgcccctttttctataattccaaactgagactgatttttcagagatttttaactttaataattttaaatctagaatcaagtgaaacagatatgttaaatactgagtctagttttcttccatcttatggagcttcatggaataagaaactaatctagtgcaaatgaagattaaatatttctgggtgatggagagatagtcaacaaatttatttatccatcctctgcacatcagtccactggagcaggagttctacacattaaaaatgtaatgggatcagcctagcattgtttggtgttcttttgttgtattttttagaatgggggtgggggcctaagtgtccttatgaagctgtggtccacgacaggagcttgttgggggagtaccagggttctgctgctttcctgcatctgagcaacacaacagagatcatcagttttaaatagagtagccctcacaatcaaaatatcatagaatatattgtaaagttatgttgctaattttcctttgaaatataaaatattttaagctttttgtcaaaagtggtaacatcttaatacaaataaaaacctttttgtggttgtaagatttagcttataaatcattcaaattgaagtgaaagaattaccaggtcattgttaatgacttagtctattaagaatatatgtatttttgtaaaggaaaagcacttgtagatatttaatcagtacaagatatgtcttttgcagaaataaaatgctgcttagagattctccttaaatattttttatttttgtgctcaaatgtattttctgttgatctatggaatgttctgtacaaagctgtataattgtactgttgggctagatactttttttttttaatctggacttagccaagtatatttcaccatgttaaaatacagtatctttgttattaaaaattaaattgcataatt

SEQ ID NO: 439667 - DNA, 2261 bp, Homo sapiens
aaagttcagatttttaatttgagagggtttttatttcatggaggcagtgttaactaaaattaagcttagatttagctcctgtattattcataatatgagaaattttattaaaggcagactttggtaaaagtgccaacacacttacttgtatagaaaagacttcattctatgggatttatataagtaagtgctttctctatattcaaaatatttcataaggacctgtggtttttttccccttaaaaagcaactctaggccgggcacagtggctcatgcctgtaatcccagcactttgggaggccaaggcaggtggatcacttgaggtcaggagttcgagaccagctggttaacatggtgaaaccccatctctactaaaaatacaaaaattagccaggtgtggtggcacgcgcctgtaatcccagctacatgggaggttgaggcaggagaatctcttgaacccaggaggtggaggttgcagtgagccgcaattacaccactgcactccagcctgggtgacacagcgagtctccatctccaaaaaaaattcaactcttggtcttgtttctcagcacttagtttattgttattagaatttagccatacagccaactttgacaaaatgggtcacagaacaagcatgtacatcaagaggaagttccatatcccccttgtaccatttctccttgggaactcatgctatgggctaccttaaaggtaaaactcatcttatggagtctttctgataggtcactaggtaaaactccttggatagggtgaaaatggatgcacactctattacatactctggtttatcataaggaattttccagaaagctaagctttatactaataagatattggttggtagtaggaacttcaaaaatgaatgagtttgccataactttaattttctggattagaaacacaaaacttgaaatgcaattatcaatattttgtaatatatattcctacagtttgggtagaaataaggaacatgtctgctagatctggtttatgaaaaagtgaaaaatattaaatacaccagagactcaaaccctttcaaggcacacaataactgttctggatttacctgacaaacctagttgagtagcattttgacagaaaatatcagactgaaagttcattcaaatgtacttaaatgtacaatacagtgttcaatagtttttattgcagtgatgtttttccaataatttaagtaattctcttcctagtataatacagttttcataaataatgtttacttgctttctttatattttcaaataaaattaaaatgctcgagcacttcctttcagaaagttatatgcccctttttctataattccaaactgagactgatttttcagagatttttaactttaataattttaaatctagaatcaagtgaaacagatatgttaaatactgagtctagttttcttccatcttatggagcttcatggaataagaaactaatctagtgcaaatgaagattaaatatttctgggtgatggagagatagtcaacaaatttatttatccatcctctgcacatcagtccactggagcaggagttctacacattaaaaatgtaatgggatcagcctagcattgtttggtgttcttttgttgtattttttagaatgggggtgggggcctaagtgtccttatgaagctgtggtccacgacaggagcttgttgggggagtaccagggttctgctgctttcctgcatctgagcaacacaacagagatcatcagttttaaatagagtagccctcacaatcaaaatatcatagaatatattgtaaagttatgttgctaattttcctttgaaatataaaatattttaagctttttgtcaaaagtggtaacatcttaatacaaataaaaacctttttgtggttgtaagatttagcttataaatcattcaaattgaagtgaaagaattaccaggtcattgttaatgacttagtctattaagaatatatgtatttttgtaaaggaaaagcacttgtagatatttaatcagtacaagatatgtcttttgcagaaataaaatgctgcttagagattctccttaaatattttttatttttgtgctcaaatgtattttctgttgatctatggaatgttctgtacaaagctgtataattgtactgttgggctagatactttttttttttaatctggacttagccaagtatatttcaccatgttaaaatacagtatctttgttattaaaaattaaattgcataatt

SEQ ID NO: 439668 - DNA, 2394 bp, Homo sapiens
aaagttcagatttttaatttgagagggtttttatttcatggaggcagtgttaactaaaattaagcttagatttagctcctgtattattcataatatgagaaattttattaaaggcagactttggtaaaagtgccaacacacttacttgtatagaaaagacttcattctatgggatttatataagtaagtgctttctctatattcaaaatatttcataaggacctgtggtttttttccccttaaaaagcaactctaggccgggcacagtggctcatgcctgtaatcccagcactttgggaggccaaggcaggtggatcacttgaggtcaggagttcgagaccagctggttaacatggtgaaaccccatctctactaaaaatacaaaaattagccaggtgtggtggcacgcgcctgtaatcccagctacatgggaggttgaggcaggagaatctcttgaacccaggaggtggaggttgcagtgagccgcaattacaccactgcactccagcctgggtgacacagcgagtctccatctccaaaaaaaattcaactcttggtcttgtttctcagcacttagtttattgttattagaatttagccatacagccaactttgacaaaatgggtcacagaacaagcatgtacatcaagaggaagttccatatcccccttgtaccatttctccttgggaactcatgctatgggctaccttaaaggtaaaactcatcttatggagtctttctgataggtcactaggtaaaactccttggatagggtgaaaatggatgcacactctattacatactctggtttatcataaggaattttccagaaagctaagctttatactaataagatattggttggtagtaggaacttcaaaaatgaatgagtttgccataactttaattttctggattagaaacacaaaacttgaaatgcaattatcaatattttgtaatatatattcctacagtttgggtagaaataaggaacatgtctgctagatctggtttatgaaaaagtgaaaaatattaaatacaccagagactcaaaccctttcaaggcacacaataactgttctggatttacctgacaaacctagttgagtagcattttgacagaaaatatcagactgaaagttcattcaaatgtacttaaatgtacaatacagtgttcaatagtttttattgcagtgatgtttttccaataatttaagtaattctcttcctagtataatacagttttcataaataatgtttacttgctttctttatattttcaaataaaattaaaatgctcgagcacttcctttcagaaagttataaaattaaaaataattattttaaatgctcattcaaatgtgtctgtatacttgctatgcccctttttctataattccaaactgagactgatttttcagagatttttaactttaataattttaaatctagaatcaagtgaaacagatatgttaaatactgagtctagttttcttccatcttatggagcttcatggaataagaaactaatctagtgcaaatgaagattaaatatttctgggtgatggagagatagtcaacaaatttatttatccatcctctgcacatcagtccactggagcaggagttctacacattaaaaatgtaatgggatcagcctagcattgtttggtgttcttttgttgtattttttagaatgggggtgggggcctaagtgtccttatgaagctgtggtccacgacaggagcttgttgggggagtaccagggttctgctgctttcctgcatctgagcaacacaacagagatcatcagttttaaatagagtagccctcacaatcaaaatatcatagaatatattgtaaagttatgttgctaattttcctttgaaatataaaatattttaagctttttgtcaaaagtggtaacatcttaatacaaataaaaacctttttgtggttgtaagatttagcttataaatcattcaaattgaagtgaaagaattaccaggtcattgttaatgacttagtctattaagaatatatgtatttttgtaaaggaaaagcacttgtagatatttaatcagtacaagatatgtcttttgcagaaataaaatgctgcttagagattctccttaaatattttttatttttgtgctcaaatgtattttctgttgatctatggaatgttctgtacaaagctgtataattgtactgttgggctagatactttttttttttaatctggacttagccaagtatatttcaccatgttaaaatacagtatctttgttattaaaaattaaattgcataatttattattgtttgtcatctttaatattagtcactgtagattgcagccttcattaaaaatatctcctttaagtactagtcc

SEQ ID NO: 439669 - DNA, 1240 bp, Homo sapiens
agaaccctcccgacccccgcgggcccccattggccggcccgctacccagccctctccgccacttccctcgcttctgaccatagtttgcggggaagggagcgagcgcgtcgaaaaccaaggaacgtgcgcgctgacgtcacggttgaggctcggagctgaggggccgcggagggcgtggcctgcgggcggttataaagaggcagtggtgcgcgcgcggccggctcagtgctgccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagca

SEQ ID NO: 439670 - DNA, 1027 bp, Homo sapiens
acagttgcaacagcaggtttataaagaggcagtactatacggttctaaggtagcgaggcggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgatagagtggggcagaaaagagcagaggggctgtgcgtggatggttctctcttcacggaccacttcgtctctcattgttagttaattggggggaggagggggcgttgttattggaaaaaaaaaaaggtttggagagggttttttgtgtttttttttttaaatggtctttttttttttcggg

SEQ ID NO: 439671 - DNA, 1206 bp, Homo sapiens
agaaccctcccgacccccgcgggcccccattggccggcccgctacccagccctctccgccacttccctcgcttctgaccatagtttgcggggaagggagcgagcgcgtcgaaaaccaaggaacgtgcgcgctgacgtcacggttgaggctcggagctgaggggccgcggagggcgtggcctgcgggcggttataaagaggcagtggtgcgcgcgcggccggctcagtgctgccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgacgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagcataaagttggaaaagcagcttctgtgtc

SEQ ID NO: 439672 - DNA, 1348 bp, Homo sapiens
  misc_feature (1194)..(1194): n is a, c, g, or t
  misc_feature (1196)..(1196): n is a, c, g, or t
agaaccctcccgacccccgcgggcccccattggccggcccgctacccagccctctccgccacttccctcgcttctgaccatagtttgcggggaagggagcgagcgcgtcgaaaaccaaggaacgtgcgcgctgacgtcacggttgaggctcggagctgaggggccgcggagggcgtggcctgcgggcggttataaagaggcagtggtgcgcgcgcggccggctcagtgctgccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctgggccgggaggtacggggccngncctgatggtttagaaagagtgaaggataataataaacaagaaacaaaagaataaaagtatacaaagacgtaatgtgggagagatgagggtaataaacttaaaagcgcattatagacagatattagaaggtggaagatgagaatgtaatcgaa

SEQ ID NO: 439673 - DNA, 1263 bp, Homo sapiens
  misc_feature (1257)..(1257): n is a, c, g, or t
agaaccctcccgacccccgcgggcccccattggccggcccgctacccagccctctccgccacttccctcgcttctgaccatagtttgcggggaagggagcgagcgcgtcgaaaaccaaggaacgtgcgcgctgacgtcacggttgaggctcggagctgaggggccgcggagggcgtggcctgcgggcggttataaagaggcagtggtgcgcgcgcggccggctcagtgctgccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacacactggcctctgtgattacatcgctcagccattaaaataaaacaagccattnaaaaaa

SEQ ID NO: 439674 - DNA, 1491 bp, Homo sapiens
acagttgcaacagcaggtttataaagaggcagtactatacggttctaaggtagcgaggcggggcggcgggttggtctacgctgtgcgcggcggacgtcggaggcagcggggagcggagcggggccgccggggcctctccagggccgcagcggcagcagttgggccccccgccccggccggcggaccgaagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagcaaaaaaaaaaaaaaaaaaaaaaaaaaaaaaaaaaaaaaaaaaaaaaaaaaaaaaaaaaaataaaaaaaaaaaaaaaaaaaaaaaaagaaaaaaaagaagaacaaaaacaacaaaaagaaacgaaaagaagcaaagagggcgcgccggcagcagagatcagctacctgacccaaaaagagagaggcgcggagcccaccaaggaccgccacgaaccagcatgttaatattaacagagagaggaaagagccgcacaaaaaagaacgaaagcaaacgacaaatattattgaatcgacgtcgaggaaggtagagtgaggagggtagagacgttagaataaaataaaataagaggaagacggggtgtgaggaagagagagagagatgcaactccattatgaggtagcgagagagcggtggggacaataaagaatcaggagagaagaagaaaaaaggacgagaatcagatgatattagagagagtgaggcgaggaagagacgaaa

SEQ ID NO: 439675 - DNA, 994 bp, Homo sapiens
acagttgcaacagcaggtttataaagaggcagtactatacggttctaaggtagcgaggcggggcggcgggttggtctacgctgtgcgcggcggacgtcggaggcagcggggagcggagcggggccgccggggcctctccagggccgcagcggcagcagttgggccccccgccccggccggcggaccgaagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagca

SEQ ID NO: 439676 - DNA, 1682 bp, Homo sapiens
agaaccctcccgacccccgcgggcccccattggccggcccgctacccagccctctccgccacttccctcgcttctgaccatagtttgcggggaagggagcgagcgcgtcgaaaaccaaggaacgtgcgcgctgacgtcacggttgaggctcggagctgaggggccgcggagggcgtggcctgcgggcggttataaagaggcagtggtgcgcgcgcggccggctcagtgctgccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaagaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagcaaaaaaaaaaaaaaaaaaaaaaaaaaaaaaaaaaaaaaaaaaaaaaaaaaaaaaaaaaaataaaaaaaaaaaaaaaaaaaaaaaaagaaaaaaaagaagaacaaaaacaacaaaaagaaacgaaaagaagcaaagagggcgcgccggcagcagagatcagctacctgacccaaaaagagagaggcgcggagcccaccaaggaccgccacgaaccagcatgttaatattaacagagagaggaaagagccgcacaaaaaagaacgaaagcaaacgacaaatattattgaatcgacgtcgaggaaggtagagtgaggagggtagagacgttagaataaaataaaataagaggaagacggggtgtgaggaagagagagagagatgcaactccattatgaggtagcgagagagcggtggggacaataaagaatcaggagagaagaagaaaaaaggacgagaatcagatgatattagagagagtgaggcgaggaagagacgaaa

SEQ ID NO: 439677 - DNA, 1179 bp, Homo sapiens
agaaccctcccgacccccgcgggcccccattggccggcccgctacccagccctctccgccacttccctcgcttctgaccatagtttgcggggaagggagcgagcgcgtcgaaaaccaaggaacgtgcgcgctgacgtcacggttgaggctcggagctgaggggccgcggagggcgtggcctgcgggcggttataaagaggcagtggtgcgcgcgcggccggctcagtgctgccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgacgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagca

SEQ ID NO: 439678 - DNA, 1118 bp, Homo sapiens
  misc_feature (18)..(18): n is a, c, g, or t
  misc_feature (64)..(64): n is a, c, g, or t
  misc_feature (76)..(76): n is a, c, g, or t
  misc_feature (85)..(85): n is a, c, g, or t
  misc_feature (98)..(98): n is a, c, g, or t
  misc_feature (102)..(103): n is a, c, g, or t
  misc_feature (107)..(107): n is a, c, g, or t
  misc_feature (114)..(114): n is a, c, g, or t
  misc_feature (132)..(132): n is a, c, g, or t
ccctccaccctaatgtcnacggtccgtgtaccaaggtcgtgtccacccgaacggtgggtcccantggcaaagtttncgttaacgngcgtcaatataancgtnnaccncgtgaancgtgatcattcaacacgnacgtgcgtgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagcaaaaaaaaaaaaaaaaaaaaaaaaaaaaaaaaaaaaaaaaaaaaaaaaaaaaaaaaaaaataaaaaaaaaaaaaaaaaaaaaaaaagaaaaaaaagaagaacaaaaacaacaaaaagaaacgaaaagaagcaaagagggcgcgccggcagcagagatcagctacctgacccaaaaagagagaggcgcggagcccaccaaggaccgccacgaaccagcatgttaatattaacagagagaggaaagagccgcacaaaaaagaacgaaagcaaacgacaaatattattgaatcgacgtcgaggaaggtagagtgaggagggtagagacgttagaataaaataaaataagaggaagacggggtgtgaggaagagagagagagatgcaactccattatgaggtagcgagagagcggtggggacaataaagaatcaggagagaagaagaaaaaaggacgagaatcagatgatattagagagagtgaggcgaggaagagacgaaa

SEQ ID NO: 439679 - DNA, 314 bp, Homo sapiens
accgcagacccacccgatggcatcaaggtctttcccaacgaggaggacctcaccgacctccaggtcaccatcgagggccctggtgagtttggaaggaaaaagagaaggggctgctgcttagatcctccatcaccctgctctagatcaccctagcgggaagtacccattacaggctggcctcgtgtcaggtgttgggatgcattggtggacagggcaggacgccacaaatgacaattatgtactcttttcccacaagggttgagaaatatctggtcattgagttagtatatcatgggacggtactctagatttga

SEQ ID NO: 439680 - DNA, 675 bp, Homo sapiens
aattaggctagtagggccggtggtgaatcggccgaggtgacactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagca

SEQ ID NO: 439681 - DNA, 1737 bp, Homo sapiens
agaaccctcccgacccccgcgggcccccattggccggcccgctacccagccctctccgccacttccctcgcttctgaccatagtttgcggggaagggagcgagcgcgtcgaaaaccaaggaacgtgcgcgctgacgtcacggttgaggctcggagctgaggggccgcggagggcgtggcctgcgggcggttataaagaggcagtggtgcgcgcgcggccggctcagtgctgccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagcaaaaaaaaaaaaaaaaaaaaaaaaaaaaaaaaaaaaaaaaaaaaaaaaaaaaaaaaaaaataaaaaaaaaaaaaaaaaaaaaaaaagaaaaaaaagaagaacaaaaacaacaaaaagaaacgaaaagaagcaaagagggcgcgccggcagcagagatcagctacctgacccaaaaagagagaggcgcggagcccaccaaggaccgccacgaaccagcatgttaatattaacagagagaggaaagagccgcacaaaaaagaacgaaagcaaacgacaaatattattgaatcgacgtcgaggaaggtagagtgaggagggtagagacgttagaataaaataaaataagaggaagacggggtgtgaggaagagagagagagatgcaactccattatgaggtagcgagagagcggtggggacaataaagaatcaggagagaagaagaaaaaaggacgagaatcagatgatattagagagagtgaggcgaggaagagacgaaa

SEQ ID NO: 439682 - DNA, 1282 bp, Homo sapiens
agaaccctcccgacccccgcgggcccccattggccggcccgctacccagccctctccgccacttccctcgcttctgaccatagtttgcggggaagggagcgagcgcgtcgaaaaccaaggaacgtgcgcgctgacgtcacggttgaggctcggagctgaggggccgcggagggcgtggcctgcgggcggttataaagaggcagtggtgcgcgcgcggccggctcagtgctgccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggggtgaagggtctcttctcttcacgtgaccaacttctgtccctcatcaatcgctcaaaattaaatatggctgggcgggaggaacgggccgggaccgcatggtacagaatagtgacggaaaaaataaacgaagaagggcatatccgggaagagaacgacgtatgatccccctctacggaaacccatggtaacggcagattatcaca

SEQ ID NO: 439683 - DNA, 1327 bp, Homo sapiens
cggacgcgtgggtcgacccacgcgtccgcctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagcaaaaaaaaaaaaaaaaaaaaaaaaaaaaaaaaaaaaaaaaaaaaaaaaaaaaaaaaaaaataaaaaaaaaaaaaaaaaaaaaaaaagaaaaaaaagaagaacaaaaacaacaaaaagaaacgaaaagaagcaaagagggcgcgccggcagcagagatcagctacctgacccaaaaagagagaggcgcggagcccaccaaggaccgccacgaaccagcatgttaatattaacagagagaggaaagagccgcacaaaaaagaacgaaagcaaacgacaaatattattgaatcgacgtcgaggaaggtagagtgaggagggtagagacgttagaataaaataaaataagaggaagacggggtgtgaggaagagagagagagatgcaactccattatgaggtagcgagagagcggtggggacaataaagaatcaggagagaagaagaaaaaaggacgagaatcagatgatattagagagagtgaggcgaggaagagacgaaa

SEQ ID NO: 439684 - DNA, 1491 bp, Homo sapiens
tgtgcctgcgaggtcgctgtggggcgagagctgggcctggagagctcccctgggagtgctacaggggcgtctgcagacgcccttctccaccgccggcagctggcgactgttcagtcactggcgagaagggagtgtgggtctgaacagcttggttgcggaaaacttcggggtctacaaacgcaggcggcgagctgacgccaaatgatgcttgctttgctggcgaggtgggtagatgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagcaaaaaaaaaaaaaaaaaaaaaaaaaaaaaaaaaaaaaaaaaaaaaaaaaaaaaaaaaaaataaaaaaaaaaaaaaaaaaaaaaaaagaaaaaaaagaagaacaaaaacaacaaaaagaaacgaaaagaagcaaagagggcgcgccggcagcagagatcagctacctgacccaaaaagagagaggcgcggagcccaccaaggaccgccacgaaccagcatgttaatattaacagagagaggaaagagccgcacaaaaaagaacgaaagcaaacgacaaatattattgaatcgacgtcgaggaaggtagagtgaggagggtagagacgttagaataaaataaaataagaggaagacggggtgtgaggaagagagagagagatgcaactccattatgaggtagcgagagagcggtggggacaataaagaatcaggagagaagaagaaaaaaggacgagaatcagatgatattagagagagtgaggcgaggaagagacgaaa

SEQ ID NO: 439685 - DNA, 1824 bp, Homo sapiens
agaaccctcccgacccccgcgggcccccattggccggcccgctacccagccctctccgccacttccctcgcttctgaccatagtttgcggggaagggagcgagcgcgtcgaaaaccaaggaacgtgcgcgctgacgtcacggttgaggctcggagctgaggggccgcggagggcgtggcctgcgggcggttataaagaggcagtggtgcgcgcgcggccggctcagtgctgccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgctttcctggaaagacaaacagtgccagacccaggacacccaagtactgttgagaagtgcccaggagcaccttactatgcaacgagtgaccatcaagtgcctgctgatccaccctaaccccgagtctgcactcaacgaggaggcgggccgcctgctcttggagaactacgaggagtatgcagctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagcaaaaaaaaaaaaaaaaaaaaaaaaaaaaaaaaaaaaaaaaaaaaaaaaaaaaaaaaaaaataaaaaaaaaaaaaaaaaaaaaaaaagaaaaaaaagaagaacaaaaacaacaaaaagaaacgaaaagaagcaaagagggcgcgccggcagcagagatcagctacctgacccaaaaagagagaggcgcggagcccaccaaggaccgccacgaaccagcatgttaatattaacagagagaggaaagagccgcacaaaaaagaacgaaagcaaacgacaaatattattgaatcgacgtcgaggaaggtagagtgaggagggtagagacgttagaataaaataaaataagaggaagacggggtgtgaggaagagagagagagatgcaactccattatgaggtagcgagagagcggtggggacaataaagaatcaggagagaagaagaaaaaaggacgagaatcagatgatattagagagagtgaggcgaggaagagacgaaa

SEQ ID NO: 439686 - DNA, 3638 bp, Homo sapiens
cggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaataacagatcttgaattgcttccctttactacttttttcttcccaagttatatactgaagtttttatttttagttgctgaggttaacattgctgcaatctga

SEQ ID NO: 439687 - DNA, 2836 bp, Homo sapiens
cggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgt

SEQ ID NO: 439688 - DNA, 2685 bp, Homo sapiens
cggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgagccaaccgtggactagtagccaaccgtggactagtagccaaccgtggactagtagccaaccgtggactagtagccaaccgtggactagtagccaaccgtggactagtagccaaccgtggactagtagccaaccgtggactagtagccaaccgtggactagtagccaa

SEQ ID NO: 439689 - DNA, 2611 bp, Homo sapiens
cggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccggtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaataacagatcttgaattgcttccctttactacttttttcttcccaagttatatactgaagtttttatttttagttgctgaggttaacattgctgcaatctga

SEQ ID NO: 439690 - DNA, 2716 bp, Homo sapiens
cggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaataacagatcttgaattgcttccctttactacttttttcttcccaagttatatactgaagtttttatttttagttgctgaggttaacattgctgcaatctga

SEQ ID NO: 439691 - DNA, 2505 bp, Homo sapiens
cggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaataacagatcttgaattgcttccctttactacttttttcttcccaagttatatactgaagtttttatttttagttgctgaggttaacattgctgcaatctga

SEQ ID NO: 439692 - DNA, 2035 bp, Homo sapiens
cggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaataacagatcttgaattgcttccctttactacttttttcttcccaagttatatactgaagtttttatttttagttgctgaggttaacattgctgcaatctga

SEQ ID NO: 439693 - DNA, 2313 bp, Homo sapiens
cggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggcagggactgcttcgtcgacgcggccgcgaatttagtagtagta

SEQ ID NO: 439694 - DNA, 2052 bp, Homo sapiens
cggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcaggagagagagcgcgacactgccagagatgccgtgagcaccggggtgaggcctgagaggagctagaaggccggatgcggagaacgcctggcccatgaatggtccagagggcaggggaagacggtgagacctgtggcaaggcaaaggtgggaacgggggaaggactgacaacggggccgcatctgaggg

SEQ ID NO: 439695 - DNA, 947 bp, Homo sapiens
agtaataaaaagagatggaataatttaaaaaaaaaaaaaaaaaaaaaaaaaaaaaccctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaataacagatcttgaattgcttccctttactacttttttcttcccaagttatatactgaagtttttatttttagttgctgaggttaacattgctgcaatctga

SEQ ID NO: 439696 - DNA, 3539 bp, Homo sapiens
  misc_feature (3394)..(3394): n is a, c, g, or t
  misc_feature (3397)..(3398): n is a, c, g, or t
  misc_feature (3422)..(3422): n is a, c, g, or t
  misc_feature (3431)..(3431): n is a, c, g, or t
  misc_feature (3499)..(3499): n is a, c, g, or t
  misc_feature (3521)..(3521): n is a, c, g, or t
cggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagattcgagcggccgatttttttttttttttnttnnttttttttttgcgaatgagtaacnttatttcantgtggggagcgggccgatgtccagcctcagaacttctggaactgcttcttggtgccggcagccttggngaccttgagcacgttggcgcantgtcttgctcagggccgg

SEQ ID NO: 439697 - DNA, 1881 bp, Homo sapiens
ttgtgtgtttgcagctggtagaggttgcagtgagccgagattgcaccactgcactccagcctgggctcaagtgattttcctgcctcagcctcctgagtagctgggactacagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaataacagatcttgaattgcttccctttactacttttttcttcccaagttatatactgaagtttttatttttagttgctgaggttaacattgctgcaatctga

SEQ ID NO: 439698 - DNA, 2216 bp, Homo sapiens
cggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggagcagtgcctggcaaccatgcatgctccgcaatcggagctgatccccttgtctcaacaatgtcagggtaccaggagcactgagttctgcacaagtcatatccccatgacaatctctac

SEQ ID NO: 439699 - DNA, 836 bp, Homo sapiens
gcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccagtgcctctccatgagaccataagctcctgtatgacagaagccatgttctttttagcggcctccgtagcatgatgggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtgaaaaaaaaaacaactaatatagcaaaaaaaaatgttttttggggcgaaaaatttcgccg

SEQ ID NO: 439700 - DNA, 366 bp, Homo sapiens
ctaaattcaatctgtctttgtaggggacaagatgccaactggcaagcagctagctgacattggctataagaccttctctacactgtgtatggggggtacctctgcagtgtccgagtctaccactatttccagtggcgcagggcccagcgccaggccgaatcatgtagaactggggggctttttctcctgagcagagaggcccaaggcatgctgtggagagacttcacctgccaccattagagcgttgatggttttcaaaccctgttggaagaaagtgcccatggtttctctggttctgccagtttgacagtttatggaggcttttgaaggtgaggtacacctacagacattaaataatttgctgtg

SEQ ID NO: 439701 - DNA, 765 bp, Homo sapiens
gcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccaggcgcggtggctcacgccgtaatcccagcactttgggaggccaaggcgagtggatcacaaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtg

SEQ ID NO: 439702 - DNA, 777 bp, Homo sapiens
gcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccagtgcctctccatgagaccataagctcctgtatgacagaagccatgttctttttagcggcctccgtagcatgatgggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtg

SEQ ID NO: 439703 - DNA, 1243 bp, Homo sapiens
gcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtgaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaacaaaaaaaaagaagtgcggcgagggccgccagaccaccgggcaccaacaaaacacactctaaccacaacaccaagagtgggggcgggccggcccaccacccgatacgaaagaatgccgacaacgggggacgacgtgagtcctgcagcaagagaaccaccccgcgtcgatcacaacaaagtgcggggcggtggtatctacccccaacactaaataaaaacaacggccggcggagcatcgcacacacagggctggttgctgaaaacagcaccaaccacacacgtagggtatgacgtcgaggcgcaacaatcagagggaggctaacaaaacaagaggagtggaccgacaaaggaggccgacaaataaaaaaataacccccgccgcggggggtggataacaaatcagaaatgaagataaaagcacacggacacctgaacggcgaaga

SEQ ID NO: 439704 - DNA, 791 bp, Homo sapiens
gcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtgaaacaaaagggttaccacctcaaatgctggccgaatttcgagctcacttggcccaattgggccctatagggaggccgttttccaat

SEQ ID NO: 439705 - DNA, 735 bp, Homo sapiens
gcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtgaaaaaaaaaagtcgacgcggccgcaattta

SEQ ID NO: 439706 - DNA, 657 bp, Homo sapiens
gcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccaggggacaagatgccaactggcaagcagctagctgacattggctataagaccttctctacctccatgatgcttctcactgtgtatggggggtacctctgcagtgtccgagtctaccactatttccagtggcgcagggcccagcgccaggcctctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtg

SEQ ID NO: 439707 - DNA, 681 bp, Homo sapiens
gcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccagagactatggaagagagtacctggatctagtttattccaaagacagacaagcagtttgtgcctccactccaggatgactaactacaacgattacacgtaaaaagacaaaacaaggccgggcgcggtggctcacgccgtaatcccagcactttgggaggccaaggcgagtggatcacaaggtgaggagatcaaaaccatcctggctaacacggtgaaaccccatctctactaaaaatacaaaaaattagctgggtgtggtggcgggcgcctgtagtcccagctactcgggaggctgaggcaggagaatggcatgaacctgggaggtggaggttgcagtgagccgagatcgtgccactgcactccagcctgggggacagagtgagactccgtctc

SEQ ID NO: 439708 - DNA, 901 bp, Homo sapiens
gcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccaggtacgctgccggctagggccgagcaggggctgccagtcccactgcctgcgcgcccacctgggccagtctccgcttgccgcgtcctcccatcccctagtctgcaggcctggtgcccttgaattcacccgcttctgttgcgttgcggaccgcgagctgcactgcttcctgcccaagcccaagctcctcgcagcagtaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtg

SEQ ID NO: 439709 - DNA, 737 bp, Homo sapiens
gcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtggctattacgattcaaaagcctccacaaacccg

SEQ ID NO: 439710 - DNA, 953 bp, Homo sapiens
  misc_feature (953)..(953): n is a, c, g, or t
gcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtgaaaaaaaaaaaaaaaaaaaaaaaaaaaaaaaaaaaaaaaaaataatctgcgggcgtttttttttcgcggggggggaaaaaaggggttattggagaaggggcatttgggcttatagtgtggtttcctcgggcccaattttttttggcaaaaggggggaaatattgggcggggtccccctatataagggggggcggttttaaatttgagaaaaacgccggggtaaccctggttttataggttcgggaatn

SEQ ID NO: 439711 - DNA, 705 bp, Homo sapiens
gcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccaggggacaagatgccaactggcaagcagctagctgacattggctataagaccttctctacctccatgatgcttctcactgtgtatggggggtacctctgcagtgtccgagtctaccactatttccagtggcgcagggcccagcgccaggccgcagaagaacagaagacctcaggaatcatgtagaactggggggctttttctcctgagcagagaggcccaaggcatgctgtggagagacttcacctgccaccatttccaggtcaacaggactagagcgttgatggttttcaaaccctgttggaagaaagtgcccatggtttctctggttctgccagtttgacagtttatggaggcttttgaatcgtaatagcaatgtgagggtgaggtacacctacagacattaaataatttgctgtg

SEQ ID NO: 439712 - DNA, 588 bp, Homo sapiens
tggccgggtgtggtggctcacatctgtaatcccagcactttgggaggccagggcgggcggatcatgaggtcaggagttcaagatcagcctggccaatatggtgaaaccctgtctctgctaaaaatacagaaattagctgggcgtggtggtgcgcacctgtagtcccagctattcaggaggctgaggcaggagaatcacttgagccctggaggcagaggttgcagtgagccgagatcgtacgactgcaccccagcctggatgacagagcgagactccatctcaaaaaaggaaaaaagtgccggtctttggttttaggatggtcttggccggtttaccttccactgagatcataatccctctgcatagtttttttagtttactggaaaactactattaattgaagcttctgatagttttcaggtggctcaaagtgaaataagaacttttggaatttcactatgtctttggttgattttacattgcgttttcattattccgatacgtcatctccctgacaagtaaggaagttgcagattaattgtggacgtaagatttttgagttgaggaaaggtgttttttctcagagcc

SEQ ID NO: 439713 - DNA, 3130 bp, Homo sapiens
  misc_feature (1)..(1): n is a, c, g, or t
  misc_feature (21)..(21): n is a, c, g, or t
  misc_feature (24)..(24): n is a, c, g, or t
  misc_feature (29)..(29): n is a, c, g, or t
nggccgcacgccgccacccancanccagngccgcctcttaaagggaggtggccggccttaaaggacccccgcgcgcccagccggcgggagcgcggcggcccggctcccgcagccgcgccgaggcaggcgagcccccgcggcgcccaggcgcgggcccgggcccccgccgccgccggcgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctctagtgagataaacctactgttgagctt

SEQ ID NO: 439714 - DNA, 3069 bp, Homo sapiens
gcgggttccttgctcccctccccggccgcctccgacgcgggcgtcctggagagcgcgccccattgtgcagggccggcggggaggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctctagtgagataaacctactgttgagctt

SEQ ID NO: 439715 - DNA, 2614 bp, Homo sapiens
  misc_feature (1)..(1): n is a, c, g, or t
  misc_feature (21)..(21): n is a, c, g, or t
  misc_feature (24)..(24): n is a, c, g, or t
  misc_feature (29)..(29): n is a, c, g, or t
nggccgcacgccgccacccancanccagngccgcctcttaaagggaggtggccggccttaaaggacccccgcgcgcccagccggcgggagcgcggcggcccggctcccgcagccgcgccgaggcaggcgagcccccgcggcgcccaggcgcgggcccgggcccccgccgccgccggcgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaatttttta

SEQ ID NO: 439716 - DNA, 3070 bp, Homo sapiens
  misc_feature (1)..(1): n is a, c, g, or t
  misc_feature (21)..(21): n is a, c, g, or t
  misc_feature (24)..(24): n is a, c, g, or t
  misc_feature (29)..(29): n is a, c, g, or t
nggccgcacgccgccacccancanccagngccgcctcttaaagggaggtggccggccttaaaggacccccgcgcgcccagccggcgggagcgcggcggcccggctcccgcagccgcgccgaggcaggcgagcccccgcggcgcccaggcgcgggcccgggcccccgccgccgccggcgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctctagtgagataaacctactgttgagctt

SEQ ID NO: 439717 - DNA, 3230 bp, Homo sapiens
  misc_feature (1)..(1): n is a, c, g, or t
  misc_feature (21)..(21): n is a, c, g, or t
  misc_feature (24)..(24): n is a, c, g, or t
  misc_feature (29)..(29): n is a, c, g, or t
nggccgcacgccgccacccancanccagngccgcctcttaaagggaggtggccggccttaaaggacccccgcgcgcccagccggcgggagcgcggcggcccggctcccgcagccgcgccgaggcaggcgagcccccgcggcgcccaggcgcgggcccgggcccccgccgccgccggcgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctctagtgagataaacctactgttgagctt

SEQ ID NO: 439718 - DNA, 3192 bp, Homo sapiens
  misc_feature (1)..(1): n is a, c, g, or t
  misc_feature (21)..(21): n is a, c, g, or t
  misc_feature (24)..(24): n is a, c, g, or t
  misc_feature (29)..(29): n is a, c, g, or t
nggccgcacgccgccacccancanccagngccgcctcttaaagggaggtggccggccttaaaggacccccgcgcgcccagccggcgggagcgcggcggcccggctcccgcagccgcgccgaggcaggcgagcccccgcggcgcccaggcgcgggcccgggcccccgccgccgccggcgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatcctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctctagtgagataaacctactgttgagctt

SEQ ID NO: 439719 - DNA, 3108 bp, Homo sapiens
  misc_feature (1)..(1): n is a, c, g, or t
  misc_feature (21)..(21): n is a, c, g, or t
  misc_feature (24)..(24): n is a, c, g, or t
  misc_feature (29)..(29): n is a, c, g, or t
nggccgcacgccgccacccancanccagngccgcctcttaaagggaggtggccggccttaaaggacccccgcgcgcccagccggcgggagcgcggcggcccggctcccgcagccgcgccgaggcaggcgagcccccgcggcgcccaggcgcgggcccgggcccccgccgccgccggcgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctctagtgagataaacctactgttgagctt

SEQ ID NO: 439720 - DNA, 1509 bp, Homo sapiens
  misc_feature (1)..(1): n is a, c, g, or t
  misc_feature (21)..(21): n is a, c, g, or t
  misc_feature (24)..(24): n is a, c, g, or t
  misc_feature (29)..(29): n is a, c, g, or t
nggccgcacgccgccacccancanccagngccgcctcttaaagggaggtggccggccttaaaggacccccgcgcgcccagccggcgggagcgcggcggcccggctcccgcagccgcgccgaggcaggcgagcccccgcggcgcccaggcgcgggcccgggcccccgccgccgccggcgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgccttttt

SEQ ID NO: 439721 - DNA, 541 bp, Homo sapiens
tattggagttgagtcttgatgagtaacattttcattggtattttccatcctaagctggatatgtttcacgtttatttcagttacgcttcttgataggaaacacatggcttcattggcagcctgcagtttccataagtatcttatgagctcttcctgttcagagcactggtgatataaaatgaaatggctttcccgttttatttttggatgctaatgacttccatctccacaggcattggaatggatacttgtgtcattcctttgaggcacggtgggctttccttggttcaaaccacagattacatttacccgatcgtagacgacccttacatgatggtaagcgtgagccgatgtgtttttgtgactggaagggcttatttgtttggtttgggttgtggctggggttttgtatgtatctgtggggttttggttttatttctgttatatcccgactatactgccccaccctgcccagactcctgcagttgctgaagtcaggcctgtcccctgcccacacttggcactgggcataaagcaatta

SEQ ID NO: 439722 - DNA, 280 bp, Homo sapiens
ttattccgatacgtcatctccctgacaagtaaggaagttgcagattaattgtggacgtaagatttttgagttgaggaaaggtgttttttctcagagccgccccctctctctcccagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcc

SEQ ID NO: 439723 - DNA, 3283 bp, Homo sapiens
  misc_feature (1)..(1): n is a, c, g, or t
  misc_feature (21)..(21): n is a, c, g, or t
  misc_feature (24)..(24): n is a, c, g, or t
  misc_feature (29)..(29): n is a, c, g, or t
nggccgcacgccgccacccancanccagngccgcctcttaaagggaggtggccggccttaaaggacccccgcgcgcccagccggcgggagcgcggcggcccggctcccgcagccgcgccgaggcaggcgagcccccgcggcgcccaggcgcgggcccgggcccccgccgccgccggcgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctctagtgagataaacctactgttgagctt

SEQ ID NO: 439724 - DNA, 3421 bp, Homo sapiens
tgtgtgataaagcaaaagatatcaaaagattttgcggaaaagtcaccttagcgaggaccgccgctttctgaaccacagtgcttccaggttgacacatgaagtgcccagaggtgctgttctaatgctgagtcctagaagaacctttgggatttgctgttcaaggtggcacggtgtcatgtgaacctgcaggctggccctcttgccacagttaaaaccacagtccagatgtcagattttacatagatgtctgtgctgacgcagtcccgttatgaaaagatctattttgtcatatgcactgctgtggtgaatataagtggtcttgatgatttcagcccttgtcacattgacttttcgctgtcatgtattcacttgattcgctggcaggtcccagtgggaattcttttcatggcatctttgtgttttggtgacacccaggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctctagtgagataaacctactgttgagctt

SEQ ID NO: 439725 - DNA, 2815 bp, Homo sapiens
cggagctgcttttcagccctaggggcgtgctcaagaatcccccgttactctgatcaaaggacttgctaagtttagaaataaagcgctttacaaatcaaatgcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctctagtgagataaacctactgttgagctt

SEQ ID NO: 439726 - DNA, 1722 bp, Homo sapiens
  misc_feature (1)..(1): n is a, c, g, or t
  misc_feature (21)..(21): n is a, c, g, or t
  misc_feature (24)..(24): n is a, c, g, or t
  misc_feature (29)..(29): n is a, c, g, or t
nggccgcacgccgccacccancanccagngccgcctcttaaagggaggtggccggccttaaaggacccccgcgcgcccagccggcgggagcgcggcggcccggctcccgcagccgcgccgaggcaggcgagcccccgcggcgcccaggcgcgggcccgggcccccgccgccgccggcgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgccttttt

SEQ ID NO: 439727 - DNA, 1635 bp, Homo sapiens
  misc_feature (1)..(1): n is a, c, g, or t
  misc_feature (21)..(21): n is a, c, g, or t
  misc_feature (24)..(24): n is a, c, g, or t
  misc_feature (29)..(29): n is a, c, g, or t
nggccgcacgccgccacccancanccagngccgcctcttaaagggaggtggccggccttaaaggacccccgcgcgcccagccggcgggagcgcggcggcccggctcccgcagccgcgccgaggcaggcgagcccccgcggcgcccaggcgcgggcccgggcccccgccgccgccggcgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaaca

SEQ ID NO: 439728 - DNA, 2998 bp, Homo sapiens
tccgggcgggggggcaaacttaggctaatacgaggccgggtgtgtaatcggccgagggcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctctagtgagataaacctactgttgagctt

SEQ ID NO: 439729 - DNA, 685 bp, Homo sapiens
  misc_feature (1)..(1): n is a, c, g, or t
  misc_feature (21)..(21): n is a, c, g, or t
  misc_feature (24)..(24): n is a, c, g, or t
  misc_feature (29)..(29): n is a, c, g, or t
nggccgcacgccgccacccancanccagngccgcctcttaaagggaggtggccggccttaaaggacccccgcgcgcccagccggcgggagcgcggcggcccggctcccgcagccgcgccgaggcaggcgagcccccgcggcgcccaggcgcgggcccgggcccccgccgccgccggcgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggtaggtaacccagtgtttctttgatggtctgcgatccaatcagtgagtcaaaaactggatttctcgcctcccatgttgcctatttattttttattattactttttttgcttttatag

SEQ ID NO: 439730 - DNA, 820 bp, Homo sapiens
actcaagatttacaaaagaacaatataaagtcttttcagatcacccttcaaaatttagtctattcttaactaatcacccttcaaaatttagtctattctagcctataaaactacaacctgtacagaacatcaacacaaacatgtctaaatattagtctagcaatcctttatcttagacttttatcacattattccaaagcaaatgactcagatctataacaaagtggggaaagagagagactactcttaacaaaacattttaaattactggctgacacctgacacaggaggatcacttgaggccttaagtttaagaccaggctgggcaatatcgtgagaccctgtctcttaccaaaaaaaaaattttttttaattatccaggcatggtggctcacccctgcagtcctacctctctggaggctgaggcaggaggatcgcttgagcccaggagttagaggatgcagtgagctatgatagcaccactgccctctagcctagacagggtgaaaccccatctctttaaaaaaaaaaaaaggggggggattttaaattatttatattgtgtaaaacatggaaagtgaaaacccttaggcaaatattcagtgaattgttcctagacctagattcaccctgctggaaaatgctaatggacactacctaggagagcctttgtctttggtttaacatcaatttaatgataatatgactgtgcattagatgcttgattgtattcttatttggaggaagaatttaaaataccctgggtagatacttccagcaacaaaacagaattaaattaattaagactattcacaacaga

SEQ ID NO: 439731 - DNA, 1978 bp, Homo sapiens
ggccgcctgcgaaagggccggctcggggagccgccaagaaacgccggctgccggcgccccctccgcgcaccgcgcagccccgccgccctgcaccgacgctccccaccacgagcaccttcagcctcctcaactgcttcccctgccccccggccctggtggtgggggaagacggagacctaaagccggcatcctcgcttcgcctccagggagactctaagcccccgcccgcccacccgctgtggaggtggcagatggggggtcccgctgtccctgagccccctggcctcaaattctgggggatcaacatggatgaaagctgaccgtgggacttctgccaaaggggaaaagttgggaccatggccaaaccgcgggcttgaggagggagccccgtttctcacatttgtccccttcctttacattttaggagctgtgggcagagggacctaaataacagtgatcttcattcaagcacctaagttttcggggtgacagtccctccccctcatcctttgcagaggaacccagggctggagtcgggagaaggctgatgacatagattccaatccctgcctccttccatctcggaccgttggaggcagggcctgcaccccagtgggagcaaaggaggccaccgctcaaagacacccccccacccaaaaaaaaggggagaagagagagacctcggtgatggacaaaccggttgttactgtgtctgtgggcgagcctggggtgcggggctgtggtgggggtggggagatgattggcagctccctgggggcatcccccacccccactgtccaggcctttaaccctttgctcccctcaggccttccctaacgctccaagcaccgctggagcctttaatgggtgagggaacttgggtaagaggaagatcacccccttcctgtcccctttctaggccccctcaagtgcaggtgacccttaattggtgagatcttcagcctcagccgccgacctttcccttttgtccagttttggagttcccgttttttccttgtttgctttccgagtgtaaggtctggccggtgagaaagatttcccccaaccttgattaatcagccccctcccccaacttacttcccttaggacgggtagggctgagggacctcctctcctggaaagtgcttactttgcctggggaaggggctagacactgtcccagggaaagtaatagaaggtggaagaaatcaataaaatcagaccaaacaagtcgcctttcgagggcctccaccgatttatggatgagagggggtggaggtggaaggcaggcccaagtccattctttggacacccaaactcagcccccttaaagagtggaaacaaaacaagctgcactttgcagaggtggtaaatgaaaggactcttggcctaacttcaagagtcccctggggtttgaaggggcaaagtttgagtctggatggaacctgggctgaggtaccttaagcttccccccgcaacaccccagcctcagggattgcgggagttgtcagagatctgatggatccgaaaggggcagggccaggggattaggtttggggtcagaggttctgttttccaggggaggggtgagataggcctggatcatgccctctgccatgccctccagctaggaggatcttgagtcagagaggattggaagtgctttctcctccacccaggtgaggtcaggggagcttaggtcttagggagatggcaagttgaggtatgaagggaagctggggcttttggagctgccgaacaactgagggacccagtgcgccttccatcccgcactagtgaatagcgccccctcttcccccgaaaacgaggtgcgagaggaacaattcccacgctggggaaggacttgtctccttttctgtgaaaatgctttgtaaaaagttgttattgtttgcatagagcagattcttgagaaaaactgttttggaccataaaagttttgtttgttttaaaaaaaatc

SEQ ID NO: 439732 - DNA, 656 bp, Homo sapiens
ggccgcctgcgaaagggccggctcggggagccgccaagaaacgccggctgccggcgccccctccgcgcaccgcgcagccccgccgccctgcaccgacgctccccaccacgagcaccttcagcctcctcaactgcttcccctgccccccggccctggtggtgggggaagacggagacctaaagccggcatcctcgcttcgcctccagggagactctaagcccccgcccgcccacccgctgtggaggtggcagatggggggtcccgctgtccctgagccccctggcctcaaattctgggggatcaacatggatgaaagctgaccgtgggacttctgccaaaggggaaaagttgggaccatggccaaaccgcgggcttgaggagggagccccgtttctcacatttgtccccttcctttacattttaggagctgtgggcagagggacctaaataacatgcgccttccatcccgcactagtgaatagcgccccctcttcccccgaaaacgaggtgcgagaggaacaattcccacgctggggaaggacttgtctccttttctgtgaaaatgctttgtaaaaagttgttattgtttgcatagagcagattcttgagaaaaactgttttggaccataaaagttttgtttgttttaaaaaaaatc

SEQ ID NO: 439733 - DNA, 1931 bp, Homo sapiens
ggccgcctgcgaaagggccggctcggggagccgccaagaaacgccggctgccggcgccccctccgcgcaccgcgcagccccgccgccctgcaccgacgctccccaccacgagcaccttcagcctcctcaactgcttcccctgccccccggccctggtggtgggggaagacggagacctaaagccggcatcctcgcttcgcctccagggagactctaagcccccgcccgcccacccgctgtggaggtggcagatggggggtcccgctgtccctgagccccctggcctcaaattctgggggatcaacatggatgaaagctgaccgtgggacttctgccaaaggggaaaagttgggaccatggccaaaccgcgggcttgaggagggagccccgtttctcacatttgtccccttcctttacattttaggagctgtgggcagagggacctaaataacagtgatcttcattcaagcacctaagttttcggggtgacagtccctccccctcatcctttgcagaggaacccagggctggagtcgggagaaggctgatgacatagattccaatccctgcctccttccatctcggaccgttggaggcagggcctgcaccccagtgggagcaaaggaggccaccgctcaaagacacccccccacccaaaaaaaaggggagaagagagagacctcggtgatggacaaaccggttgttactgtgtctgtgggcgagcctggggtgcggggctgtggtgggggtggggagatgattggcagctccctgggggcatcccccacccccactgtccaggcctttaaccctttgctcccctcaggccttccctaacgctccaagcaccgctggagcctttaatgggtgagggaacttgggtaagaggaagatcacccccttcctgtcccctttctaggccccctcaagtgcaggtgacccttaattggtgagatcttcagcctcagccgccgacctttcccttttgtccagttttggagttcccgttttttccttgtttgctttccgagtgtaaggtctggccggtgagaaagatttcccccaaccttgattaatcagccccctcccccaacttacttcccttaggacgggtagggctgagggacctcctctcctggaaataatagaaggtggaagaaatcaataaaatcagaccaaacaagtcgcctttcgagggcctccaccgatttatggatgagagggggtggaggtggaaggcaggcccaagtccattctttggacacccaaactcagcccccttaaagagtggaaacaaaacaagctgcactttgcagaggtggtaaatgaaaggactcttggcctaacttcaagagtcccctggggtttgaaggggcaaagtttgagtctggatggaacctgggctgaggtaccttaagcttccccccgcaacaccccagcctcagggattgcgggagttgtcagagatctgatggatccgaaaggggcagggccaggggattaggtttggggtcagaggttctgttttccaggggaggggtgagataggcctggatcatgccctctgccatgccctccagctaggaggatcttgagtcagagaggattggaagtgctttctcctccacccaggtgaggtcaggggagcttaggtcttagggagatggcaagttgaggtatgaagggaagctggggcttttggagctgccgaacaactgagggacccagtgcgccttccatcccgcactagtgaatagcgccccctcttcccccgaaaacgaggtgcgagaggaacaattcccacgctggggaaggacttgtctccttttctgtgaaaatgctttgtaaaaagttgttattgtttgcatagagcagattcttgagaaaaactgttttggaccataaaagttttgtttgttttaaaaaaaatc

SEQ ID NO: 439734 - DNA, 555 bp, Homo sapiens
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439735 - DNA, 493 bp, Homo sapiens
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439736 - DNA, 577 bp, Homo sapiens
ggagccatttgctttcgcgtctgcggtgctcggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439737 - DNA, 865 bp, Homo sapiens
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaaaaaaattttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacagaggtatctcacttgtatgcttacacctgcacaagatcgtgtatgttaaatcgtgggtattaggccttaat

SEQ ID NO: 439738 - DNA, 2161 bp, Homo sapiens
  misc_feature (44)..(44): n is a, c, g, or t
gaaaatgatctccaaaagatttctcagcaaggcagatttacttntgcagaatggtgctgcttgcactcctggtcacagtgagagcaccccgaacaaaggaggtgaagtggtttttatccctaacacagctagttcctgcttctgtgtcctatccccattggctagagtccaatctaaactagtcctgattggctattttaaacaggaggggtgtgggttacagcagtgggaagagcagttgccacgagcgagggagacttttccagataaggaacaaatgcgggttacaggttgggattggtgggagaaatgtttacagaatgggtaattaggagtgggaaggtatgaggaagttgaccttaagaacaaagaacaaggaagttaaactttgaagagaaacccatcatacctaacagtcttgtaagaaaggatgacaaagtgattgaacattgggtggagctaattttccttggccaattcacttagtaagataaggagctccaaatcatatttaagttgggagtcaattgattttacttaattcttgtgaggttcagttataagattcatcatactactaccatgagccatcctcagctccttgttacatgggcctgttaacatggcagctttgtctataagcaaacccaggagagaaagacatagcagagatggatgtttgaagtctataccttccaccccctttaaagagaaagtaacaccactccttttctgtgtcccttggggacactacctccatgtctggtcacatggctggactttacagcagataagcatactgtggcctgagaccatgattgtatgctttccttctgctgacctttacaatccctcaataaattgagctaacacagggaagcttttttaccaaataactgtgttgcatcatcctccagtttgcctggtgtccttaatcaatggaaggggaataagcaaactgagttttcttacaccttttgagtatagtgtttttgccatcatagatgtggctcctcataattctccaacttttatattaaaaaaccaaaacctcaaaaattgtagttcatgtcagtcagtgatgactcatcttagaagtattttgtttttggatgtgtgaatgtgcatagttcttaaagtccaacattcatgtaataagacatcttgcatataacaatgacccttacgtctaagatgttaaatagatcctaagcctggtataactttattcaagtatccttatttgcccctaaaatgtctttaatacacattacttgggttatttcttgaatgaacatacaggtatcccaatttctgtttttaagagaatggggtcttgctctgtcacccaggctggagtgcagtggtgcagtcatggcttactgcatccatgatcctcctgcctcagcctcccaagtagatgggactgaaagcacacactgccatccctggctaatgttttcatattttgtagagttgcagccttgctacgtgacccaggctggagtgtagtagctattcacaggcatgattgcttgaaactcatggcttcaagggaaactcccaccctcaatatcctcagtagctgcaactacagccataccccccactgctcagcttctcatcctttaaaagatttttactggtagtgtcctcattctgggtttttgtcttctgtgtttactgtgacatgaagtcatttttagatgaaggttaaacattttgccaacgcaggtacaatatgggattcaataaaagtacagaattaaagttgtcttattagagattgggaagtttcccagctccgtttatcggtacttggccgtaccgataaaggggatggacttggagtgaccaggtcttagtcacatgtattttcataccctaaacaagaagcggtatagaccagaatggagcactgattgtaatccaccttctttcttagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439739 - DNA, 515 bp, Homo sapiens
ggagccatttgctttcgcgtctgcggtgctcggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439740 - DNA, 940 bp, Homo sapiens
  misc_feature (867)..(867): n is a, c, g, or t
ggagccatttgctttcgcgtctgcggtgctcggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaaaaaaaaaccaaaaaaaatatctataaacacaaagaaaaacaaattcaaacttacacattatccaatcattctattattataaatatatgaaaaaaaaaaaaacttgggggcccgcttggcccagggggttttaaatctggaccaatttattcttggggcccaatttggggctcattttggccaattgcccctttaggggaggcgtttacaattcatgggccggtttttcaaacggtggtatttggaaaacccctggggttacccaatttttaaacccttgggaaaaaatncccttttttcacagtggggggaaattccgaaggccccgccccgtgaggccttttccatttggcccctctttgg

SEQ ID NO: 439741 - DNA, 653 bp, Homo sapiens
  misc_feature (517)..(517): n is a, c, g, or t
  misc_feature (533)..(533): n is a, c, g, or t
  misc_feature (535)..(535): n is a, c, g, or t
  misc_feature (548)..(548): n is a, c, g, or t
  misc_feature (593)..(593): n is a, c, g, or t
  misc_feature (620)..(620): n is a, c, g, or t
  misc_feature (650)..(650): n is a, c, g, or t
ggagccatttgctttcgcgtctgcggtgctcggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaaanttttttttttttctcngngggggggcccggnacccaatcgccctataggggggcggattacaattcactgggccgncggtttacaacggcggggctggggaanccctggggggtacccaacttattcgcttgnagg

SEQ ID NO: 439742 - DNA, 748 bp, Homo sapiens
  misc_feature (55)..(55): n is a, c, g, or t
gggctgactctagaggattttcaacttcgacgacattcaggcttcatacgctatngtcctgccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaaaaaaaaaaaaaaaactcgagactagttctctcaggcctcagaagggcccagcgtgggacataccgccgtaggcttccctacaatacagcctctacaaaaactaggctgtccgaccctggtaatgatggttccctttatccccagaggtgggacgcccaatctgctgtgggtgtcccggcgactcaggtcgggcgagaccaagtctttggttgccac

SEQ ID NO: 439743 - DNA, 444 bp, Homo sapiens
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgatgaccatcacacacaggtacacgtggctcccaaccaatttatatgtatatatatattctacttccacaccgcattcatcctggttcaatcaaagcctaggtt

SEQ ID NO: 439744 - DNA, 269 bp, Homo sapiens
cctctctggcggcggctgctgctagggagtcgacttctcctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439745 - DNA, 500 bp, Homo sapiens
gttgatctcaaactcctggtctcaagtgatcctcctgcctcaccctccgaaagtgctttttaaaaatgttaaaaacaaacataggctctggagctagacttgggtttaaatcccggctctgttatgtattagccattggctcaatcttctttttcttttcctagattttgcctgcctgagctcctctagtagtggccacaattgccagagaagatagagcaggtctctcccaggacttgcagctccagcctgtgtctgcaaggggtgttgtagcgactgatttctccagcccatggcaagaggccttcatcttgtgcctggaaagagggaagtacaagtccgtctggcagagatggtgcagatgggcaagtttttcagacactgcagccagcacttctgggaccgcagcagtggagcctgcagagggccggttctccaggcatgggctactgacattgtcacttccagactccttatgcaataaacaacccctaaacaga

SEQ ID NO: 439746 - DNA, 452 bp, Homo sapiens
tcttgctctgtcacccaggctggagtgcaatggtgcgatcttagctcactgcagcctccaccttccgggttcaagcaatcctcccacctcagcctcctgagtagctgtgactacagattttgcctgcctgagctcctctagtagtggccacaattgccagagaagatagagcaggtctctcccaggacttgcagctccagcctgtgtctgcaaggggtgttgtagcgactgatttctccagcccatggcaagaggccttcatcttgtgcctggaaagagggaagtacaagtccgtctggcagagatggtgcagatgggcaagtttttcagacactgcagccagcacttctgggaccgcagcagtggagcctgcagagggccggttctccaggcatgggctactgacattgtcacttccagactccttatgcaataaacaacccctaaacaga

SEQ ID NO: 439747 - DNA, 393 bp, Homo sapiens
ggagccatttgctttcgcgtctgcggtgctcggagtgtggtacttctcctagttgcagtcaggcttcatacgctattgtcctgcccgtaagttcccgttttgtgtgtggtgagtggaaactccatgttcttcgttggagacctctggtcctcccttcccttctttgtgccgtcgtctctgcggccagccctaatctccttctcgtggcttctccgtctctgaccccaaataggccttaagggcgtgggagaaatgagtttctggagctggaaaagccactgccttctgcacgggcctgagaagcccttggctggtgtaaatgatgacttcacttttttccccatcagatcgacaatgctgacgtcttatattttgccagttagttctgataca

SEQ ID NO: 439748 - DNA, 560 bp, Homo sapiens
  misc_feature (81)..(82): n is a, c, g, or t
tctagaggaccccctcgctctgatagcctttcgtacggataacattcacacagtctttctaatgcggaggttcatacgctnngtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439749 - DNA, 918 bp, Homo sapiens
  misc_feature (845)..(845): n is a, c, g, or t
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaaaaaaaaaccaaaaaaaatatctataaacacaaagaaaaacaaattcaaacttacacattatccaatcattctattattataaatatatgaaaaaaaaaaaaacttgggggcccgcttggcccagggggttttaaatctggaccaatttattcttggggcccaatttggggctcattttggccaattgcccctttaggggaggcgtttacaattcatgggccggtttttcaaacggtggtatttggaaaacccctggggttacccaatttttaaacccttgggaaaaaatncccttttttcacagtggggggaaattccgaaggccccgccccgtgaggccttttccatttggcccctctttgg

SEQ ID NO: 439750 - DNA, 1656 bp, Homo sapiens
ccgtgggaagatggcggttaacgccctttatttgttggttcacaggttagagcagccagcgggtacagaatggattttggaagagggagtcaccactggacctccaaggaagccacgtgcagacatctacaaccttcgatctcctgacgagtaagtctttgtctcctatgggtctactgtagaaaacacgtgctttgagaagctttagttttctaggaaaacgtgggatttaacaaagcactttctatcgagcatttattaggtatttaaaaaagtgttctgacggccgggcgctgtggctgacgcctgtaaccccagcaaactcacaaggctgaggcaggagaattgcccgaacccgggcggcggaggttgtagtgagttgagattgcgccactgccctacagtcggggcaacagagccagactccgtctcaaaaaaaaaaaaaaaagaaaaacatgttctgaatgttttattctcacagttcaaatattggaactaggtttctggtgaagaaacaggtttaagagaaatgcctgaagtgaaagaaccttgttagtgaagaggcgtttaacattttaatgccacttaaacatatttttggattccattcttcctgtgtgttggggcgcttaaatttccaagtggagggatgatttattgacatattttggaaagccaaatgtgtttttctgttgaactagccactcaaaccagtgcccgactacataactaatatttttgctagagtccaggagtgaggcgtttacaaagtctgggcttcatgggaacacatgtgaagcttattgttccagattgttcttttgtcaggtaacttgtggtaacttgtgttaaaatgcaatctcttggtacttgttcacttcccaactcagtaaatgccaactacttcctcaactcttccagccacactggcttctatcatgggcctgtactcagagtgtaagcactgaagacaggggtgtttggtttggctaccaagttattgccagctacaggatacaacacagaagtgctcaaacaccgaatgcaaatttgcaaatatgaagcataccaaccaaatcttactcctcatggctttcaaatcttactcctcactcaagaacttcctgctggcatatatgatgacttagcttttttccccgacagatcgactatgttgatctaacttttctaagccagtttctgtctgatatgccagcttgagcagctcctttgtcccagctcccctgggcatctagctgatgggagctcatttttctgttttttcatttcaggtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439751 - DNA, 1697 bp, Homo sapiens
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtaagtctttgtctcctatgggtctactgtagaaaacacgtgctttgagaagctttagttttctaggaaaacgtgggatttaacaaagcactttctatcgagcatttattaggtatttaaaaaagtgttctgacggccgggcgctgtggctgacgcctgtaaccccagcaaactcacaaggctgaggcaggagaattgcccgaacccgggcggcggaggttgtagtgagttgagattgcgccactgccctacagtcggggcaacagagccagactccgtctcaaaaaaaaaaaaaaaagaaaaacatgttctgaatgttttattctcacagttcaaatattggaactaggtttctggtgaagaaacaggtttaagagaaatgcctgaagtgaaagaaccttgttagtgaagaggcgtttaacattttaatgccacttaaacatatttttggattccattcttcctgtgtgttggggcgcttaaatttccaagtggagggatgatttattgacatattttggaaagccaaatgtgtttttctgttgaactagccactcaaaccagtgcccgactacataactaatatttttgctagagtccaggagtgaggcgtttacaaagtctgggcttcatgggaacacatgtgaagcttattgttccagattgttcttttgtcaggtaacttgtggtaacttgtgttaaaatgcaatctcttggtacttgttcacttcccaactcagtaaatgccaactacttcctcaactcttccagccacactggcttctatcatgggcctgtactcagagtgtaagcactgaagacaggggtgtttggtttggctaccaagttattgccagctacaggatacaacacagaagtgctcaaacaccgaatgcaaatttgcaaatatgaagcataccaaccaaatcttactcctcatggctttcaaatcttactcctcactcaagaacttcctgctggcatatatgatgacttagcttttttccccgacagatcgactatgttgatctaacttttctaagccagtttctgtctgatatgccagcttgagcagctcctttgtcccagctcccctgggcatctagctgatgggagctcatttttctgttttttcatttcaggtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439752 - DNA, 969 bp, Homo sapiens
gctggcactcctctaaacgatctgaccctgcatgcatgcctgctatgtatcggtacattgtatgagtaaggcgtgaatgagagatctgggcttcatgggaacacatgtgaagcttattgttccagattgttcttttgtcaggtaacttgtggtaacttgtgttaaaatgcaatctcttggtacttgttcacttcccaactcagtaaatgccaactacttcctcaactcttccagccacactggcttctatcatgggcctgtactcagagtgtaagcactgaagacaggggtgtttggtttggctaccaagttattgccagctacaggatacaacacagaagtgctcaaacaccgaatgcaaatttgcaaatatgaagcataccaaccaaatcttactcctcatggctttcaaatcttactcctcactcaagaacttcctgctggcatatatgatgacttagcttttttccccgacagatcgactatgttgatctaacttttctaagccagtttctgtctgatatgccagcttgagcagctcctttgtcccagctcccctgggcatctagctgatgggagctcatttttctgttttttcatttcaggtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439753 - DNA, 2471 bp, Homo sapiens
  misc_feature (44)..(44): n is a, c, g, or t
gaaaatgatctccaaaagatttctcagcaaggcagatttacttntgcagaatggtgctgcttgcactcctggtcacagtgagagcaccccgaacaaaggaggtgaagtggtttttatccctaacacagctagttcctgcttctgtgtcctatccccattggctagagtccaatctaaactagtcctgattggctattttaaacaggaggggtgtgggttacagcagtgggaagagcagttgccacgagcgagggagacttttccagataaggaacaaatgcgggttacaggttgggattggtgggagaaatgtttacagaatgggtaattaggagtgggaaggtatgaggaagttgaccttaagaacaaagaacaaggaagttaaactttgaagagaaacccatcatacctaacagtcttgtaagaaaggatgacaaagtgattgaacattgggtggagctaattttccttggccaattcacttagtaagataaggagctccaaatcatatttaagttgggagtcaattgattttacttaattcttgtgaggttcagttataagattcatcatactactaccatgagccatcctcagctccttgttacatgggcctgttaacatggcagctttgtctataagcaaacccaggagagaaagacatagcagagatggatgtttgaagtctataccttccaccccctttaaagagaaagtaacaccactccttttctgtgtcccttggggacactacctccatgtctggtcacatggctggactttacagcagataagcatactgtggcctgagaccatgattgtatgctttccttctgctgacctttacaatccctcaataaattgagctaacacagggaagcttttttaccaaataactgtgttgcatcatcctccagtttgcctggtgtccttaatcaatggaaggggaataagcaaactgagttttcttacaccttttgagtatagtgtttttgccatcatagatgtggctcctcataattctccaacttttatattaaaaaaccaaaacctcaaaaattgtagttcatgtcagtcagtgatgactcatcttagaagtattttgtttttggatgtgtgaatgtgcatagttcttaaagtccaacattcatgtaataagacatcttgcatataacaatgacccttacgtctaagatgttaaatagatcctaagcctggtataactttattcaagtatccttatttgcccctaaaatgtctttaatacacattacttgggttatttcttgaatgaacatacaggtatcccaatttctgtttttaagagaatggggtcttgctctgtcacccaggctggagtgcagtggtgcagtcatggcttactgcatccatgatcctcctgcctcagcctcccaagtagatgggactgaaagcacacactgccatccctggctaatgttttcatattttgtagagttgcagccttgctacgtgacccaggctggagtgtagtagctattcacaggcatgattgcttgaaactcatggcttcaagggaaactcccaccctcaatatcctcagtagctgcaactacagccataccccccactgctcagcttctcatcctttaaaagatttttactggtagtgtcctcattctgggtttttgtcttctgtgtttactgtgacatgaagtcatttttagatgaaggttaaacattttgccaacgcaggtacaatatgggattcaataaaagtacagaattaaagttgtcttattagagattgggaagtttcccagctccgtttatcggtacttggccgtaccgataaaggggatggacttggagtgaccaggtcttagtcacatgtattttcataccctaaacaagaagcggtatagaccagaatggagcactgattgtaatccaccttctttcttagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaaaaaaattttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacagaggtatctcacttgtatgcttacacctgcacaagatcgtgtatgttaaatcgtgggtattaggccttaat

SEQ ID NO: 439754 - DNA, 819 bp, Homo sapiens
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacaggtctccaagcaaattcaagttctccccctgtgagagacacgaggtaaaattggcattgaaccggatagcttgatggccctcgggggctgacccgcagggtgtcggacttcaggggacttcaggaaacagcagcgagagagtttggcatagcttattgccccaggttgtggggtcttggaagagagctgccatacaacttaatgcctgatcggctggaggacgatccgagtggaaagggaacaatctggggctctggcttaccacaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439755 - DNA, 1594 bp, Homo sapiens
ccgtgggaagatggcggttaacgccctttatttgttggttcacaggttagagcagccagcgggtacagaatggattttggaagagggagtcaccactggacctccaaggaagccacgtgcagacatctacaaccttcgatctcctgacgagtaagtctttgtctcctatgggtctactgtagaaaacacgtgctttgagaagctttagttttctaggaaaacgtgggatttaacaaagcactttctatcgagcatttattaggtatttaaaaaagtgttctgacggccgggcgctgtggctgacgcctgtaaccccagcaaactcacaaggctgaggcaggagaattgcccgaacccgggcggcggaggttgtagtgagttgagattgcgccactgccctacagtcggggcaacagagccagactccgtctcaaaaaaaaaaaaaaaagaaaaacatgttctgaatgttttattctcacagttcaaatattggaactaggtttctggtgaagaaacaggtttaagagaaatgcctgaagtgaaagaaccttgttagtgaagaggcgtttaacattttaatgccacttaaacatatttttggattccattcttcctgtgtgttggggcgcttaaatttccaagtggagggatgatttattgacatattttggaaagccaaatgtgtttttctgttgaactagccactcaaaccagtgcccgactacataactaatatttttgctagagtccaggagtgaggcgtttacaaagtctgggcttcatgggaacacatgtgaagcttattgttccagattgttcttttgtcaggtaacttgtggtaacttgtgttaaaatgcaatctcttggtacttgttcacttcccaactcagtaaatgccaactacttcctcaactcttccagccacactggcttctatcatgggcctgtactcagagtgtaagcactgaagacaggggtgtttggtttggctaccaagttattgccagctacaggatacaacacagaagtgctcaaacaccgaatgcaaatttgcaaatatgaagcataccaaccaaatcttactcctcatggctttcaaatcttactcctcactcaagaacttcctgctggcatatatgatgacttagcttttttccccgacagatcgactatgttgatctaacttttctaagccagtttctgtctgatatgccagcttgagcagctcctttgtcccagctcccctgggcatctagctgatgggagctcatttttctgttttttcatttcaggtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439756 - DNA, 865 bp, Homo sapiens
gtgcaagctatccggttcaatctacatttttatttagagttgaccaccagaacaacatggattcaaacttgcagctatttgattttgggccttaaatctatctggcactcctcgtgggattccaatggcatctatataaacatgagagtcacgagggacatccattgttttatgatgttctgtttttatgtatgttttctggatgaaataccagggtgaaagggagatagccaattggattagagctcaagtcccacgccaagtaacttggcagagtattcagtaatggtccaccacaacaccaccatacgtttgcttggggatgaataagggacgactgattggtaagctcctggaagggcttaagctcactgcatctcgttaggtctccaagcaaattcaagttctccccctgtgagagacacgaggtaaaattggcattgaaccggatagcttgatggccctcgggggctgacccgcagggtgtcggacttcaggggacttcaggaaacagcagcgagagagtttggcatagcttattgccccaggttgtggggtcttggaagagagctgccatacaacttaatgcctgatcggctggaggacgatccgagtggaaagggaacaatctggggctctggcttaccacaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439757 - DNA, 915 bp, Homo sapiens
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggtaagtggtgccaacacgtcttccctggctgagtagacacaggctctggagggggtagtagctgcttttcagtgtgggtttgtcaccctacttcttgtacgactcaaatgtggcctttgcagctgatgatacagcttctttccccatcagatcgaccctgttgatctctacactattggccagttttgtctgatgcattggccccagtaataactcctatctttgttttctgcttatctttatcagagactattgcttgttcatgggaactgggctttctctattttttccagcattcagatggcttcttttgacctgttaactttctataggtggcgcccgtttccacggcgctgtggaaagtggggggaacacaactggccgttaaaagagaagagacgcgaaacatgtgcagaccacgcgcaatttccaagggcaccccaaccaccacgggttcaaaggggcaaaaaatcactaccatgcgcgggcaaaaactctggtgaacacagtgaaacagcaccaaagtgcgccatagtcggagtgttgttacaacaagaatataatcttcgtctctctctcttctgcctcctctacacctccatcctcgaaaaaagaagagaagagagagagaagagaca

SEQ ID NO: 439758 - DNA, 429 bp, Homo sapiens
ggagccatttgctttcgcgtctgcggtgctcggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgaaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439759 - DNA, 2016 bp, Homo sapiens
ccgtgggaagatggcggttaacgccctttatttgttggttcacaggttagagcagccagcgggtacagaatggattttggaagagggagtcaccactggacctccaaggaagccacgtgcagacatctacaaccttcgatctcctgacgagtaagtctttgtctcctatgggtctactgtagaaaacacgtgctttgagaagctttagttttctaggaaaacgtgggatttaacaaagcactttctatcgagcatttattaggtatttaaaaaagtgttctgacggccgggcgctgtggctgacgcctgtaaccccagcaaactcacaaggctgaggcaggagaattgcccgaacccgggcggcggaggttgtagtgagttgagattgcgccactgccctacagtcggggcaacagagccagactccgtctcaaaaaaaaaaaaaaaagaaaaacatgttctgaatgttttattctcacagttcaaatattggaactaggtttctggtgaagaaacaggtttaagagaaatgcctgaagtgaaagaaccttgttagtgaagaggcgtttaacattttaatgccacttaaacatatttttggattccattcttcctgtgtgttggggcgcttaaatttccaagtggagggatgatttattgacatattttggaaagccaaatgtgtttttctgttgaactagccactcaaaccagtgcccgactacataactaatatttttgctagagtccaggagtgaggcgtttacaaagtctgggcttcatgggaacacatgtgaagcttattgttccagattgttcttttgtcaggtaacttgtggtaacttgtgttaaaatgcaatctcttggtacttgttcacttcccaactcagtaaatgccaactacttcctcaactcttccagccacactggcttctatcatgggcctgtactcagagtgtaagcactgaagacaggggtgtttggtttggctaccaagttattgccagctacaggatacaacacagaagtgctcaaacaccgaatgcaaatttgcaaatatgaagcataccaaccaaatcttactcctcatggctttcaaatcttactcctcactcaagaacttcctgctggcatatatgatgacttagcttttttccccgacagatcgactatgttgatctaacttttctaagccagtttctgtctgatatgccagcttgagcagctcctttgtcccagctcccctgggcatctagctgatgggagctcatttttctgttttttcatttcaggtttattgttggccaaaaccaggctttgattgaaccaggatgaatgcgggtgttggaagtagaatatatatatacatataaaattggtaagtggtgccaacacgtcttccctggctgagtagacacaggctctggagggggtagtagctgcttttcagtgtgggtttgtcaccctacttcttgtacgactcaaatgtggcctttgcagctgatgatacagcttctttccccatcagatcgaccctgttgatctctacactattggccagttttgtctgatgcattggccccagtaataactcctatctttgttttctgcttatctttatcagagactattgcttgttcatgggaactgggctttctctattttttccagcattcagatggcttcttttgacctgttaactttctataggtggcgcccgtttccacggcgctgtggaaagtggggggaacacaactggccgttaaaagagaagagacgcgaaacatgtgcagaccacgcgcaatttccaagggcaccccaaccaccacgggttcaaaggggcaaaaaatcactaccatgcgcgggcaaaaactctggtgaacacagtgaaacagcaccaaagtgcgccatagtcggagtgttgttacaacaagaatataatcttcgtctctctctcttctgcctcctctacacctccatcctcgaaaaaagaagagaagagagagagaagagaca

SEQ ID NO: 439760 - DNA, 1867 bp, Homo sapiens
  misc_feature (1231)..(1231): n is a, c, g, or t
  misc_feature (1244)..(1244): n is a, c, g, or t
ccgtgggaagatggcggttaacgccctttatttgttggttcacaggttagagcagccagcgggtacagaatggattttggaagagggagtcaccactggacctccaaggaagccacgtgcagacatctacaaccttcgatctcctgacgagtaagtctttgtctcctatgggtctactgtagaaaacacgtgctttgagaagctttagttttctaggaaaacgtgggatttaacaaagcactttctatcgagcatttattaggtatttaaaaaagtgttctgacggccgggcgctgtggctgacgcctgtaaccccagcaaactcacaaggctgaggcaggagaattgcccgaacccgggcggcggaggttgtagtgagttgagattgcgccactgccctacagtcggggcaacagagccagactccgtctcaaaaaaaaaaaaaaaagaaaaacatgttctgaatgttttattctcacagttcaaatattggaactaggtttctggtgaagaaacaggtttaagagaaatgcctgaagtgaaagaaccttgttagtgaagaggcgtttaacattttaatgccacttaaacatatttttggattccattcttcctgtgtgttggggcgcttaaatttccaagtggagggatgatttattgacatattttggaaagccaaatgtgtttttctgttgaactagccactcaaaccagtgcccgactacataactaatatttttgctagagtccaggagtgaggcgtttacaaagtctgggcttcatgggaacacatgtgaagcttattgttccagattgttcttttgtcaggtaacttgtggtaacttgtgttaaaatgcaatctcttggtacttgttcacttcccaactcagtaaatgccaactacttcctcaactcttccagccacactggcttctatcatgggcctgtactcagagtgtaagcactgaagacaggggtgtttggtttggctaccaagttattgccagctacaggatacaacacagaagtgctcaaacaccgaatgcaaatttgcaaatatgaagcataccaaccaaatcttactcctcatggctttcaaatcttactcctcactcaagaacttcctgctggcatatatgatgacttagcttttttccccgacagatcgactatgttgatctaacttttctaagccagtttctgtctgataactttcaaaattttgctttgntgcaacattcttntctaagctttttctctgagatgtttgtagatttatttttatttgcgtgttttaaggtggttcatggtgcaacaattctctttaccttggccgatttggtaagtgtggttgctcagttttctaagtgaggttgcctctatcggttcatatttcattctagtacttgttcttcgcagatattcttgtcttcacgtgttacccttccactgtgatcttttctcttcatccctctgattccttctcttcgtgctcttattggatagcccttcttaatattcccgtttagctacgcctgctttcctcaatgcctcatatgggtttgtttattcaatgctttatccttaaatctgttatcaaccttctctccaccttaggaagatttcaaaccactctgggcattttgtattttgtccttacattttccgtaaattcattttttgcagatttatttatggtctgcttgtctcccattttatcttccatgctacatttatctactcttcttttcctgtcacttaattttccctggcccctagctctcttatgttcggaattattctaatgggcctaattggcgcctagggttatctctccccatatttctgcgttgtttcaccttgcccg

SEQ ID NO: 439761 - DNA, 433 bp, Homo sapiens
cttcgatctcctgacgagtaagtctttgtctcctatgggtctactgtagaaaacacgtgctttgagaagctttagttttctaggaaaacgtgggatttaacaaagcactttctatcgagcatttattaggtatttaaaaaagtgttctgacggccgggcgctgtggctgacgcctgtaaccccagcacttggggaggccaaggcagatgggtcacctgaggtcaagatttggagaccagcctggccaacatggtgaaaccctgactctattaaaaatacagaaattagctgggcgtggtggtacgcgcctgtaatcccagcaactcacaaggctgaggcaggagaattgcccgaacccgggcggcggaggttgtagtgagttgagattgcgccactgccctacagtcggggcaacagagccagactccgtctc

SEQ ID NO: 439762 - DNA, 660 bp, Homo sapiens
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaaaaaaaacaaaaacaaaaaaacttgtggtggggggccttgggccccggaaaaggttttttaacccttccgttggggggggggggccccttggtttgcggccccctg

SEQ ID NO: 439763 - DNA, 954 bp, Homo sapiens
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaaaaaaaaaaaagggggggccgccctttttttttttttttttgggaggtccccaacaattcttgggtaattctttccccaaaaggtaaatatacccgaagggtttttaaagttccacaaaaaaaaccttatttgggttccttccccaaagaaaaaaaaaatacatgagagcaacagcccagcccgatagacagcacagagacaactcgcaaccaacaagtccgcccaacgacaagcagaaacaaaaggagggcggcgagccaacacatcagcaaggcgacaagacccacagccaagaggcaggcggccgacagtgacataacaacgagcggccccacggcaacgacaaccgacgataagaacgacgtgtgtgaagacacaccccaccgccgaacgacgggatggcaccagcgagacctatagtacgcgaagcagccaagacgaagagcggggaagcaaggaaa

SEQ ID NO: 439764 - DNA, 407 bp, Homo sapiens
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgaaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439765 - DNA, 675 bp, Homo sapiens
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagattttgcctgcctgagctcctctagtagtggccacaattgccagagaagatagagcaggtctctcccaggacttgcagctccagcctgtgtctgcaaggggtgttgtagcgactgatttctccagcccatggcaagaggccttcatcttgtgcctggaaagagggaagtacaagtccgtctggcagagatggtgcagatgggcaagtttttcagacactgcagccagcacttctgggaccgcagcagtggagcctgcagagggccggttctccaggcatgggctactgacattgtcacttccagactccttatgcaataaacaacccctaaacaga

SEQ ID NO: 439766 - DNA, 988 bp, Homo sapiens
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgaaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatcaaaaagaaagatgtaaaaaaaataaaataaatacaaaaatcaaacacgggcggaggctccggccatagaagaatcgcctccccgaagggtgcgcacaccgtctattgtctcgccccacaccgctaacttctttattccgctctacgagggtgagcgccccctgctttagggcgcgtgcacgctattgtgaaaggtcatttggagcccccctgctgggcgcgccagagcgttacttgtcgcaacccacaccacgccttgcaaccgagcgaggcgtgggagcgatcccaacacccggcggagcgccgcaaagtcaggttgtgccggccgattatcttcgttcgctgtccgttgaagctaccggttgggaaacccccctatctttccatacgcgggtctcccttgaacttgcggcagggggcgatgtgaccaggaggcataaaataagtgcgtcgtgaggcgacctacttcacacatcctgctcccccccttacatgccgaagtacaactctgtgtgaacgccatcggggctgtcccccctacgttgcggcgcagctctgcccccatacattaatcgggaca

SEQ ID NO: 439767 - DNA, 532 bp, Homo sapiens
  misc_feature (55)..(55): n is a, c, g, or t
gggctgactctagaggattttcaacttcgacgacattcaggcttcatacgctatngtcctgccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439768 - DNA, 631 bp, Homo sapiens
  misc_feature (495)..(495): n is a, c, g, or t
  misc_feature (511)..(511): n is a, c, g, or t
  misc_feature (513)..(513): n is a, c, g, or t
  misc_feature (526)..(526): n is a, c, g, or t
  misc_feature (571)..(571): n is a, c, g, or t
  misc_feature (598)..(598): n is a, c, g, or t
  misc_feature (628)..(628): n is a, c, g, or t
ggagccatttgctttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaaanttttttttttttctcngngggggggcccggnacccaatcgccctataggggggcggattacaattcactgggccgncggtttacaacggcggggctggggaanccctggggggtacccaacttattcgcttgnagg

SEQ ID NO: 439769 - DNA, 498 bp, Homo sapiens
  misc_feature (81)..(82): n is a, c, g, or t
tctagaggaccccctcgctctgatagcctttcgtacggataacattcacacagtctttctaatgcggaggttcatacgctnngtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 439770 - DNA, 709 bp, Homo sapiens
gagcgacgcggccacaagcccaggaacctggagcccccagaagccgtgagaggcaggaaggttcctcccttggagacttcggagggaacgcaaccctgcagacatcttttgttttgttttgtttttagagacagggttgcgttctgtcgcccaggctggagtgcagtggtgcggtctcggctcacttcagcctccactgcccaggctcaagcaatcctcccacctcagcctcccgagtagccgggactgtaggcatgagccaccccacctgggtaactttttgttatcataatgtagagatggggtctcactatgttgcccaggctggtcttgaattcccgggctcaagcgattcacccgcctcccaaggtgctgggattacaggtgtgagccgccaccctgaagagaagttggttttggacttctgggctccgggaccgcgggagaatagatttctgttgctttaagctgcaacgtgtggctgtaagggagttaaggatcgatttgagatgaggtggccctaaaaccagcaggctggtgtcctgagaagaggagagagagacggggagacggtcttgtggagacggaggcagagactggagcgctgcggccacaagccaggacgcaccttgatctggggttcccgggcccctggaccgggagaggacactgtcttgtcccaggccacctggtttctggtgccctcgtg

SEQ ID NO: 439771 - DNA, 2896 bp, Homo sapiens
agcgtgtttctctgtggccccgtgcggggcgaccttgctacccaggcccacagtaggctgtatgcgaagagcctgcgcctctgcctccaagaaggcctccaggtttctgcaaatgcgtgaatgagccggatgccagcctctgtcccctggagcccagcgtgaggaagaggcatgccccatcagccttcagcttgagcccggcggcccccgcccccgccccctgccaccctgcactgccccggctcccccgcggcccccacgctgcagtgcggccgggccccctccccgcaggggccgcccccgccgcccacccctagcgcccgtggtggtggtggtggtggtggtggtggtggcccgggccgcagggccatgaaactacaggccgtgatggagacgctgttgcagcggcagcagcgggcgcgccaggagctggaggcccggcagcagctgccccccgatccccctgctgcaccccccggccgggcccgggctgcccccgacgaggacagagagcccgagagtgcccggatgcagcgggctcagatggccgcactggcagccatgcgggctgcagctgcgggcctgggacacccagccagccccggcggctctgaggatgggcccccaggctcggaggaggaggacgcggcccgggaggggacaccgggctcacccgggcgaggcagagaagggccaggagaggagcactttgaggacatggcctccgacgaggacatgaagcccaaatgggaggaggaggagatggaggaagacctcggggaggatgaggaggaggaggaggaggattacgaggatgaggaggaggaggaggacgaggaggggctgggccccccaggccctgccagcttgggcaccacggcactgttcccccgaaaggcccagccaccccaggccttccgcggcgatggcgttcccagggtgctggggggccaggagcggccggggcctggccctgcccaccccggaggggccgcccacgtagccccgcagctgcagccgcctgaccacggcgactggacttacgaggagcagtttaagcagctctacgaactcgacggggaccccaagaggaaggaattcctggatgacttgttcagcttcatgcagaagcgagggacacctgtgaaccgcatccccatcatggccaaacaggtccttgacctgttcatgctgtacgtgctggtgacggagaagggcggcctcgtggaggtcatcaacaagaagctgtggcgtgagatcaccaagggcctcaacctgcccacgtccatcaccagtgcagccttcaccctgcggacccaatacatgaagtacctgtacccctacgagtgtgagaagcggggcctcagtaaccccaatgagctccaggcagccatagacagcaaccgacgggagggccggcgccagagctttggtggctccctctttgcctactcgccaggcggggcacacggcatgctctcctcacccaagctacccgtgtcctccctgggcctggccgcaagcaccaacggcagctccatcacccccgcccctaagatcaagaaagaggaggactcagccatccccatcacagtccctggccgcctgcctgtgtccctggcgggccaccctgtggtggcagcccaggcagcagctgtgcaagcagcagccgcccaagcagctgtggccgcacaggcagctgccctggaacagctgcgggagaagctggagtctgcagagcctccggagaagaagatggccctggtggccgatgagcagcaacggctgatgcaacgtgcactccagcagaacttcctggccatggcggcccagctgcccatgagcattcggatcaacagccaagcctccgaaagccgccaggactctgctgtgaacctgacgggcaccaacggcagcaacagcatcagcatgtcggtggagatcaacggcatcatgtacacaggagttctgtttgctcagccgccggcccccacgccaacctctgctcccaacaaaggaggcggcggcggcggcggcagcagcagcaacgcaggcggccggggaggaaacaccggaaccagcggcggccaggctgggccagcggggctgtccacaccctccacatctacctcaaataactcgttgccttaaccgcatcactccccacccgccacccaccctggagcccgccggcctgggcagggggtccaggtgggccacacaggggccaggatggcggaagatacgggtggggagggaagatatccagaaaggagccacagctgacgccaaaaagaaaagaaaaaagatatatatatatatatatatatatatacgtatatatataaagagaatttaataaaacaggggaaaaccaaggaacacttgaatttctcaggttttggacattcagagagatgaattgtgagaacagcaaagaaatccatcagaaaaacagaaagaggcagacgtttcccagggcgttcaggcagccctgatggaccgaaggctctggtgtctggtttggccccacagcagtgtgggccgatcctgtttacctcatacatccctgcactgtgtgttttcatttttgtctgctttagttctcttttattttctattcaccacacactcaccactcccagcttctcgtgtccagtgaaacccctgaaccaagatcactgaatttttgtttttttcttgttgctttgggaaatttttttttctctgtagggtttttaagaggtttcgggggttttgttgtgtaaatattctattttattcttggggggatcaaaccttaggaaaaggatatctatatatctatatagctatatatttgtgttccttcagggaaactggtcttgaaaaagcaagaaaaaaaagcaaaaaaaaa

SEQ ID NO: 439772 - DNA, 2106 bp, Homo sapiens
gagcgacgcggccacaagcccaggaacctggagcccccagaagccgtgagaggcaggaaggttcctcccttggagacttcggagggaacgcaaccctgcagacatcttttgttttgttttgtttttagagacagggttgcgttctgtcgcccaggctggagtgcagtggtgcggtctcggctcacttcagcctccactgcccaggctcaagcaatcctcccacctcagcctcccgagtagccgggactgtaggcatgagccaccccacctggctctacgaactcgacggggaccccaagaggaaggaattcctggatgacttgttcagcttcatgcagaagcgagggacacctgtgaaccgcatccccatcatggccaaacaggtccttgacctgttcatgctgtacgtgctggtgacggagaagggcggcctcgtggaggtcatcaacaagaagctgtggcgtgagatcaccaagggcctcaacctgcccacgtccatcaccagtgcagccttcaccctgcggacccaatacatgaagtacctgtacccctacgagtgtgagaagcggggcctcagtaaccccaatgagctccaggcagccatagacagcaaccgacgggagggccggcgccagagctttggtggctccctctttgcctactcgccaggcggggcacacggcatgctctcctcacccaagctacccgtgtcctccctgggcctggccgcaagcaccaacggcagctccatcacccccgcccctaagatcaagaaagaggaggactcagccatccccatcacagtccctggccgcctgcctgtgtccctggcgggccaccctgtggtggcagcccaggcagcagctgtgcaagcagcagccgcccaagcagctgtggccgcacaggcagctgccctggaacagctgcgggagaagctggagtctgcagagcctccggagaagaagatggccctggtggccgatgagcagcaacggctgatgcaacgtgcactccagcagaacttcctggccatggcggcccagctgcccatgagcattcggatcaacagccaagcctccgaaagccgccaggactctgctgtgaacctgacgggcaccaacggcagcaacagcatcagcatgtcggtggagatcaacggcatcatgtacacaggagttctgtttgctcagccgccggcccccacgccaacctctgctcccaacaaaggaggcggcggcggcggcggcagcagcagcaacgcaggcggccggggaggaaacaccggaaccagcggcggccaggctgggccagcggggctgtccacaccctccacatctacctcaaataactcgttgccttaaccgcatcactccccacccgccacccaccctggagcccgccggcctgggcagggggtccaggtgggccacacaggggccaggatggcggaagatacgggtggggagggaagatatccagaaaggagccacagctgacgccaaaaagaaaagaaaaaagatatatatatatatatatatatatatacgtatatatataaagagaatttaataaaacaggggaaaaccaaggaacacttgaatttctcaggttttggacattcagagagatgaattgtgagaacagcaaagaaatccatcagaaaaacagaaagaggcagacgtttcccagggcgttcaggcagccctgatggaccgaaggctctggtgtctggtttggccccacagcagtgtgggccgatcctgtttacctcatacatccctgcactgtgtgttttcatttttgtctgctttagttctcttttattttctattcaccacacactcaccactcccagcttctcgtgtccagtgaaacccctgaaccaagatcactgaatttttgtttttttcttgttgctttgggaaatttttttttctctgtagggtttttaagaggtttcgggggttttgttgtgtaaatattctattttattcttggggggatcaaaccttaggaaaaggatatctatatatctatatagctatatatttgtgttccttcagggaaactggtcttgaaaaagcaagaaaaaaaagcaaaaaaaaa

SEQ ID NO: 439773 - DNA, 1187 bp, Homo sapiens
aaaaaaataaaaaattagccagacatggtggcacgcccctgtggtctcagctactcgggaggctgagctgggaggatcacttgagcccatgaggttgaggctgcagtgagctctgatgccaccactgcactctagcctgggggacagagtgagagagaagtttattccccggagcaccccattgggtctcccttgtggcccgcctcgcatcttcttaaactctgcatggcatatgtcttctgttcttgccttaggagttctgtttgctcagccgccggcccccacgccaacctctgctcccaacaaaggaggcggcggcggcggcggcagcagcagcaacgcaggcggccggggaggaaacaccggaaccagcggcggccaggctgggccagcggggctgtccacaccctccacatctacctcaaataactcgttgccttaaccgcatcactccccacccgccacccaccctggagcccgccggcctgggcagggggtccaggtgggccacacaggggccaggatggcggaagatacgggtggggagggaagatatccagaaaggagccacagctgacgccaaaaagaaaagaaaaaagatatatatatatatatatatatatatacgtatatatataaagagaatttaataaaacaggggaaaaccaaggaacacttgaatttctcaggttttggacattcagagagatgaattgtgagaacagcaaagaaatccatcagaaaaacagaaagaggcagacgtttcccagggcgttcaggcagccctgatggaccgaaggctctggtgtctggtttggccccacagcagtgtgggccgatcctgtttacctcatacatccctgcactgtgtgttttcatttttgtctgctttagttctcttttattttctattcaccacacactcaccactcccagcttctcgtgtccagtgaaacccctgaaccaagatcactgaatttttgtttttttcttgttgctttgggaaatttttttttctctgtagggtttttaagaggtttcgggggttttgttgtgtaaatattctattttattcttggggggatcaaaccttaggaaaaggatatctatatatctatatagctatatatttgtgttccttcagggaaactggtcttgaaaaagcaagaaaaaaaagcaaaaaaaaa

SEQ ID NO: 439774 - DNA, 2255 bp, Homo sapiens
agcgtgtttctctgtggccccgtgcggggcgaccttgctacccaggcccacagtaggctgtatgcgaagagcctgcgcctctgcctccaagaaggcctccaggtttctgcaaatgcgtgaatgagccggatgccagcctctgtcccctggagcccagcgtgaggaagaggcatgccccatcagccttcagcttgagcccggcggcccccgcccccgccccctgccaccctgcactgccccggctcccccgcggcccccacgctgcagtgcggccgggccccctccccgcaggggccgcccccgccgcccacccctagcgcccgtggtggtggtggtggtggtggtggtggtggcccgggccgcagggccatgaaactacaggccgtgatggagacgctgttgcagcggcagcagcgggcgcgccaggagctggaggcccggcagcagctgccccccgatccccctgctgcaccccccggccgggcccgggctgcccccgacgaggacagagagcccgagagtgcccggatgcagcgggctcagatggccgcactggcagccatgcgggctgcagctgcgggcctgggacacccagccagccccggcggctctgaggatgggcccccaggctcggaggaggaggacgcggcccgggaggggacaccgggctcacccgggcgaggcagagaagggccaggagaggagcactttgaggacatggcctccgacgaggacatgaagcccaaatgggaggaggaggagatggaggaagacctcggggaggatgaggaggaggaggaggaggattacgaggatgaggaggaggaggaggacgaggaggggctgggccccccaggccctgccagcttgggcaccacggcactgttcccccgaaaggcccagccaccccaggccttccgcggcgatggcgttcccagggtgctggggggccaggagcggccggggcctggccctgcccaccccggaggggccgcccacgtagccccgcagctgcagccgcctgaccacggcgactggacttacgaggagcagtttaagcagctctacgaactcgacggggaccccaagaggaaggaattcctggatgacttgttcagcttcatgcagaagcgagggacacctgtgaaccgcatccccatcatggccaaacaggtccttgacctgttcatgctgtacgtgctggtgacggagaagggcggcctcgtggaggtcatcaacaagaagctgtggcgtgagatcaccaagggcctcaacctgcccacgtccatcaccagtgcagccttcaccctgcggacccaatacatgaagtacctgtacccctacgagtgtgagaagcggggcctcagtaaccccaatgagctccaggcagccatagacagcaaccgacgggagggccggcgccagagctttggtggctccctctttgcctactcgccaggcggggcacacggcatgctctcctcacccaagctacccgtgtcctccctgggcctggccgcaagcaccaacggcagctccatcacccccgcccctaagatcaagaaagaggaggactcagccatccccatcacagtccctggccgcctgcctgtgtccctggcgggccaccctgtggtggcagcccaggcagcagctgtgcaagcagcagccgcccaagcagctgtggccgcacaggcagctgccctggaacagctgcgggagaagctggagtctgcagagcctccggagaagaagatggccctggtggccgatgagcagcaacggctgatgcaacgtgcactccagcagaacttcctggccatggcggcccagctgcccatgagcattcggatcaacagccaagcctccgaaagccgccaggactctgctgtgaacctgacgggcaccaacggcagcaacagcatcagcatgtcggtggagatcaacggcatcatgtacacaggtaggacccctgaggccacgccctgcctggacctcgcctctcccgccgccgtgaactcaggaccctgagttgcgcctggtcccacctgcttgaacctaggtgtgcgggcgagcagggcacggccaggggctttgcaggacaaacagtcaagactgatggagaggataccatcgttcacccggtaccacgctcagcccagagggggtcgtccacagatacatattcagtgtgacgttggatggttcacattcctagttttttgttttaatgagacggagtcttgcacagacat

SEQ ID NO: 439775 - DNA, 407 bp, Homo sapiens
gccactgcaccccagcctgggctacagagcaagactccgtctcaaaaaaaaaaaaaaaaaaaaatcctcatcctcctaaagaggagactaggggtcagacaggatcacagagggaagtgtcttgcccatggtcacacagcagttcgacagcagagagggccagggtgaccagacaggtggtggtaaggtgcaaggaccaacattaaagtcagtaatctgggtttgaatcggctttgccacgtccatgtgcctgctgtattcctgggtgagttgattaacctctctgagcttccatttttccacctgtaaaatagggatcatctgtaattcacacaattttcatgagattccaggtgccaaacacagggataagtgcttaataaatgtttatttgttttgaaaagcgt

SEQ ID NO: 439776 - DNA, 4275 bp, Homo sapiens
gttggcgcatgcgcgcgaggtgcgcaggctcgcgcctttttcccttttctaagctttctgtgttacccccggttccgctgtcttttctgtctacagtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagcatctgaagcaaacacacttagaatatttcagcctttggtgtctaatgttaaccctggagtcacaatcgaaggataataaaaagaatcaccaaaatatctggctaatgcctgcttcggaaatggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacagaaacttgtcggtccttccagaatcaactttgttcagattagaccaagaagaaaaaaattgtgatatagataccccattaggaaatctttccaaattgatggaaaacacgtttgtcagcaaaaaacttcgagatttaattattgactttcgtgaacctcagtttatatcctaccttagttctgttcttccacatgatgcaaaggatacagttgcctgcattctaaagggtttgaataagcctcagaggcaagcgatgaaaaaggtacttctttcaaaagactacacactcatcgtgggtatgcctgggacaggaaaaacaactacgatatgtactctcgtaagaattctctacgcctgtggttttagcgttttgttgaccagctatacacactctgctgttgacaatattcttttgaagttagccaagtttaaaataggatttttgcgtttgggtcagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaagagctcttggcatgagtgaaagcttattcaagaggctggagcagaataagagtgctgttgtacagttaaccgtgcagtacagaatgaacagtaaaattatgtccttaagtaataagctgacctatgagggcaagctggagtgtggatcagacaaagtggccaatgcagtgataaacctacgtcactttaaagatgtgaagctggaactggaattttatgctgactattctgataatccttggttgatgggagtatttgaacccaacaatcctgtttgtttccttaatacagacaaggttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatcattgatcttccatcaagagaacatgaaagtctttgccacatattgggtgactttcaaagagaataaaacactatttcccttgccttttcatactagggcagtatctcctctagctagtgcccatacagaaaattctatcaccatacaaaatttaatgcagtatttatgttttaaagcacaggtgtaccgaaaactgtgaaaagtctgaatttatgggttctatgcatgcatttttgcctaacctagagaaagagtttgataaatttttaccagctttgaagatggattaacttttgactttgagctttaaacttttaagtcagacatttcaggactaatttgattttgtagatatcattgtaagaactttatttgaaagactgaataaagggatttgatttgttttcatcatttaagcacagtcttgtgatgatgagaacataagtgtgattcttttctgtattttgaggtccctaatccaaagcccattttgctaggattttttctgctatcagatgtgttttcactctaaacctagtcttttatgacatgaattgattacttcctgttaattttctatcctcccttactatcctccttttttgttttcagtattcagtatttcagtattctagagtagattttgatataaaagaaaataattcttacatcatcttttgcaacaaattttgttttctgaattgataataaatttaaaaagttgattcctattttcacatatgttcatatgcccctatgtttgggggtatcactcagttttcccttttttgtgtaaagatgttttgtaaaacaaaattgtctcaaagtgattatattatatatataaaaagtaacagattttaacaaaggttaaaagattcttggggtaacagattcttctggggcttggaaatcttccatttctcttgagggttttttttaatgagtgttaaatatgttaaaatttttatttctacctcatgtgtttttttaaattattacttgaagttttttatttaataaattttttctactaatgga

SEQ ID NO: 439777 - DNA, 595 bp, Homo sapiens
ggacagctatttcttcctttttttttttaatagagacaggcttttgccatgttgtccgggctggtcttgaacttctggtctccagtgatccacctgcctcggcctcccaaagtactgggattacaggcatgagccactacacctggcctcattctattcttaaatttgcacaggtgtccattgtgtagggatgtgttgtaatatatttaaccattcctttgaacttgaataattgaaaattatatttcttacaggttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatatcctttttcttctgtatatggtcacatttgattgcactgttgtgagtatttatttgcttgtttaaattaaagctctcactatgttgcttaagctggtcttgaactcctgggctcaagcgatcctcctgtgtaggcctcccaaagtgctgtgattacagatgtgagccacggcccccagcctataacccttt

SEQ ID NO: 439778 - DNA, 396 bp, Homo sapiens
tgtttccctttgtctagaggatatgtgaaggagattaacatgacaacagtaacttgtttattagacagatttcagaagaaagtggtagcttcctttccaagaacagttctgagcacaggaatggataaccggtacctggtgttggcagtcaatactgagacgctttacagccccagaccctgaaaggtcagaaggctgtcttattctcaatatgcattttattttattacccagtctgctcctgacatgaaataaagctcccaaaattaaattctggccctcagaccccactacaggacttaattaacctcacgttcaaggtgtacataatagagtagaggcagccagtagcaatgtatttctgagtgcattcctgcctcccttgagacaaagggc

SEQ ID NO: 439779 - DNA, 4360 bp, Homo sapiens
gttggcgcatgcgcgcgaggtgcgcaggctcgcgcctttttcccttttctaagctttctgtgttacccccggttccgctgtcttttctgtctacagtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagcatctgaagcaaacacacttagaatatttcagcctttggtgtctaatgttaaccctggagtcacaatcgaaggataataaaaagaatcaccaaaatatctggctaatgcctgcttcggaaatggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacagaaacttgtcggtccttccagaatcaactttgttcagattagaccaagaagaaaaaaattgtgatatagataccccattaggaaatctttccaaattgatggaaaacacgtttgtcagcaaaaaacttcgagatttaattattgactttcgtgaacctcagtttatatcctaccttagttctgttcttccacatgatgcaaaggatacagttgcctgcattctaaagggtttgaataagcctcagaggcaagcgatgaaaaaggtacttctttcaaaagactacacactcatcgtgggtatgcctgggacaggaaaaacaactacgatatgtactctcgtaagaattctctacgcctgtggttttagcgttttgttgaccagctatacacactctgctgttgacaatattcttttgaagttagccaagtttaaaataggatttttgcgtttgggtcagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaagagctcttggcatgagtgaaagcttattcaagaggctggagcagaataagagtgctgttgtacagttaaccgtgcagtacagaatgaacaggtatttgtaacagtgttagctaggagtggttttcatgtttgtttccatctaccaaaactaaagttatcttttgtaattcccttagtaaaattatgtccttaagtaataagctgacctatgagggcaagctggagtgtggatcagacaaagtggccaatgcagtgataaacctacgtcactttaaagatgtgaagctggaactggaattttatgctgactattctgataatccttggttgatgggagtatttgaacccaacaatcctgtttgtttccttaatacagacaaggttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatcattgatcttccatcaagagaacatgaaagtctttgccacatattgggtgactttcaaagagaataaaacactatttcccttgccttttcatactagggcagtatctcctctagctagtgcccatacagaaaattctatcaccatacaaaatttaatgcagtatttatgttttaaagcacaggtgtaccgaaaactgtgaaaagtctgaatttatgggttctatgcatgcatttttgcctaacctagagaaagagtttgataaatttttaccagctttgaagatggattaacttttgactttgagctttaaacttttaagtcagacatttcaggactaatttgattttgtagatatcattgtaagaactttatttgaaagactgaataaagggatttgatttgttttcatcatttaagcacagtcttgtgatgatgagaacataagtgtgattcttttctgtattttgaggtccctaatccaaagcccattttgctaggattttttctgctatcagatgtgttttcactctaaacctagtcttttatgacatgaattgattacttcctgttaattttctatcctcccttactatcctccttttttgttttcagtattcagtatttcagtattctagagtagattttgatataaaagaaaataattcttacatcatcttttgcaacaaattttgttttctgaattgataataaatttaaaaagttgattcctattttcacatatgttcatatgcccctatgtttgggggtatcactcagttttcccttttttgtgtaaagatgttttgtaaaacaaaattgtctcaaagtgattatattatatatataaaaagtaacagattttaacaaaggttaaaagattcttggggtaacagattcttctggggcttggaaatcttccatttctcttgagggttttttttaatgagtgttaaatatgttaaaatttttatttctacctcatgtgtttttttaaattattacttgaagttttttatttaataaattttttctactaatgga

SEQ ID NO: 439780 - DNA, 2377 bp, Homo sapiens
tcttttttctcttacccattattaggtaagaattctctacgcctgtggttttagcgttttgttgaccagctatacacactctgctgttgacaatattcttttgaagttagccaagtttaaaataggatttttgcgtttgggtcagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaaggtaggcagacacttaagtgttaattttaaactagattattttcaaggaacagatttagtacactgataaacatgaatctgatttattgacagagctcttggcatgagtgaaagcttattcaagaggctggagcagaataagagtgctgttgtacagttaaccgtgcagtacagaatgaacaggtatttgtaacagtgttagctaggagtggttttcatgtttgtttccatctaccaaaactaaagttatcttttgtaattcccttagtaaaattatgtccttaagtaataagctgacctatgagggcaagctggagtgtggatcagacaaagtggccaatgcagtgataaacctacgtcactttaaagatgtgaagctggaactggaattttatgctgactattctgataatccttggttgatgggagtatttgaacccaacaatcctgtttgtttccttaatacagacaaggttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatcattgatcttccatcaagagaacatgaaagtctttgccacatattgggtgactttcaaagagaataaaacactatttcccttgccttttcatactagggcagtatctcctctagctagtgcccatacagaaaattctatcaccatacaaaatttaatgcagtatttatgttttaaagcacaggtgtaccgaaaactgtgaaaagtctgaatttatgggttctatgcatgcatttttgcctaacctagagaaagagtttgataaatttttaccagctttgaagatggattaacttttgactttgagctttaaacttttaagtcagacatttcaggactaatttgattttgtagatatcattgtaagaactttatttgaaagactgaataaagggatttgatttgttttcatcatttaagcacagtcttgtgatgatgagaacataagtgtgattcttttctgtattttgaggtccctaatccaaagcccattttgctaggattttttctgctatcagatgtgttttcactctaaacctagtcttttatgacatgaattgattacttcctgttaattttctatcctcccttactatcctccttttttgttttcagtattcagtatttcagtattctagagtagattttgatataaaagaaaataattcttacatcatcttttgcaacaaattttgttttctgaattgataataaatttaaaaagttgattcctattttcacatatgttcatatgcccctatgtttgggggtatcactcagttttcccttttttgtgtaaagatgttttgtaaaacaaaattgtctcaaagtgattatattatatatataaaaagtaacagattttaacaaaggttaaaagattcttggggtaacagattcttctggggcttggaaatcttccatttctcttgagggttttttttaatgagtgttaaatatgttaaaatttttatttctacctcatgtgtttttttaaattattacttgaagttttttatttaataaattttttctactaatgga

SEQ ID NO: 439781 - DNA, 2308 bp, Homo sapiens
gttatttttgaatttaaatgtaggtttgaataagcctcagaggcaagcgatgaaaaaggtacttctttcaaaagactacacactcatcgtgggtatgcctgggacaggaaaaacaactacgatatgtactctcgtaagaattctctacgcctgtggttttagcgttttgttgaccagctatacacactctgctgttgacaatattcttttgaagttagccaagtttaaaataggatttttgcgtttgggtcagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaagagctcttggcatgagtgaaagcttattcaagaggctggagcagaataagagtgctgttgtacagttaaccgtgcagtacagaatgaacagtaaaattatgtccttaagtaataagctgacctatgagggcaagctggagtgtggatcagacaaagtggccaatgcagtgataaacctacgtcactttaaagatgtgaagctggaactggaattttatgctgactattctgataatccttggttgatgggagtatttgaacccaacaatcctgtttgtttccttaatacagacaaggttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatcattgatcttccatcaagagaacatgaaagtctttgccacatattgggtgactttcaaagagaataaaacactatttcccttgccttttcatactagggcagtatctcctctagctagtgcccatacagaaaattctatcaccatacaaaatttaatgcagtatttatgttttaaagcacaggtgtaccgaaaactgtgaaaagtctgaatttatgggttctatgcatgcatttttgcctaacctagagaaagagtttgataaatttttaccagctttgaagatggattaacttttgactttgagctttaaacttttaagtcagacatttcaggactaatttgattttgtagatatcattgtaagaactttatttgaaagactgaataaagggatttgatttgttttcatcatttaagcacagtcttgtgatgatgagaacataagtgtgattcttttctgtattttgaggtccctaatccaaagcccattttgctaggattttttctgctatcagatgtgttttcactctaaacctagtcttttatgacatgaattgattacttcctgttaattttctatcctcccttactatcctccttttttgttttcagtattcagtatttcagtattctagagtagattttgatataaaagaaaataattcttacatcatcttttgcaacaaattttgttttctgaattgataataaatttaaaaagttgattcctattttcacatatgttcatatgcccctatgtttgggggtatcactcagttttcccttttttgtgtaaagatgttttgtaaaacaaaattgtctcaaagtgattatattatatatataaaaagtaacagattttaacaaaggttaaaagattcttggggtaacagattcttctggggcttggaaatcttccatttctcttgagggttttttttaatgagtgttaaatatgttaaaatttttatttctacctcatgtgtttttttaaattattacttgaagttttttatttaataaattttttctactaatgga

SEQ ID NO: 439782 - DNA, 1927 bp, Homo sapiens
gttggcgcatgcgcgcgaggtgcgcaggctcgcgcctttttcccttttctaagctttctgtgttacccccggttccgctgtcttttctgtctacagtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagcatctgaagcaaacacacttagaatatttcagcctttggtgtctaatgttaaccctggagtcacaatcgaaggataataaaaagaatcaccaaaatatctggctaatgcctgcttcggaaatggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacaggtaatgaaatgttactttttttgataacagctttattgatatataattcacatctgtgtagttcatccatttaaaatgtacaattcgctggtttttagtatattcacagcgttgtgcagctatcaccacaatcaactttgagtattttcatcaccccaaaaaga

SEQ ID NO: 439783 - DNA, 561 bp, Homo sapiens
ccaatcccagctaattatgtatttttagtagagacggggtttcaccgtgttggttaggctagtcttgaacccctgacctcaggtgatccgcccacctcagcctccccaagtgttgggattacaggcgtaagccattgtgcccggccctaaaatgtttttaaatctgcaagttttacatatgtagtgaaaaagacatgataaactttatttaactcttaaaaagacattcaccttttttttcatagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcaggtaaatattgtctaccaaaggcattatttctagttgagtatgaactcaactaaatacgtttaacactggtggccagacgggcattgataacatcattttagttatttttcctttatattttccttcgtattatttctaaaattaagataatag

SEQ ID NO: 439784 - DNA, 216 bp, Homo sapiens
aacaagtaagttgtaggaaaatgcagacacaatacttacgtatgtaatataaacagaagtttttttctctttggtcttttcatagggagaagagtggcagttgcattggaaacctgattagaatggaacatgtaaagatagtttgtgatgggcaatatttacataatttccaatgtaaacatggtgccatacctgtcacaaatctaatggcaggtg

SEQ ID NO: 439785 - DNA, 4452 bp, Homo sapiens
gttggcgcatgcgcgcgaggtgcgcaggctcgcgcctttttcccttttctaagctttctgtgttacccccggttccgctgtcttttctgtctacagtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagcatctgaagcaaacacacttagaatatttcagcctttggtgtctaatgttaaccctggagtcacaatcgaaggataataaaaagaatcaccaaaatatctggctaatgcctgcttcggaaatggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacagaaacttgtcggtccttccagaatcaactttgttcagattagaccaagaagaaaaaaattgtgatatagataccccattaggaaatctttccaaattgatggaaaacacgtttgtcagcaaaaaacttcgagatttaattattgactttcgtgaacctcagtttatatcctaccttagttctgttcttccacatgatgcaaaggatacagttgcctgcattctaaagggtttgaataagcctcagaggcaagcgatgaaaaaggtacttctttcaaaagactacacactcatcgtgggtatgcctgggacaggaaaaacaactacgatatgtactctcgtaagaattctctacgcctgtggttttagcgttttgttgaccagctatacacactctgctgttgacaatattcttttgaagttagccaagtttaaaataggatttttgcgtttgggtcagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaaggtaggcagacacttaagtgttaattttaaactagattattttcaaggaacagatttagtacactgataaacatgaatctgatttattgacagagctcttggcatgagtgaaagcttattcaagaggctggagcagaataagagtgctgttgtacagttaaccgtgcagtacagaatgaacaggtatttgtaacagtgttagctaggagtggttttcatgtttgtttccatctaccaaaactaaagttatcttttgtaattcccttagtaaaattatgtccttaagtaataagctgacctatgagggcaagctggagtgtggatcagacaaagtggccaatgcagtgataaacctacgtcactttaaagatgtgaagctggaactggaattttatgctgactattctgataatccttggttgatgggagtatttgaacccaacaatcctgtttgtttccttaatacagacaaggttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatcattgatcttccatcaagagaacatgaaagtctttgccacatattgggtgactttcaaagagaataaaacactatttcccttgccttttcatactagggcagtatctcctctagctagtgcccatacagaaaattctatcaccatacaaaatttaatgcagtatttatgttttaaagcacaggtgtaccgaaaactgtgaaaagtctgaatttatgggttctatgcatgcatttttgcctaacctagagaaagagtttgataaatttttaccagctttgaagatggattaacttttgactttgagctttaaacttttaagtcagacatttcaggactaatttgattttgtagatatcattgtaagaactttatttgaaagactgaataaagggatttgatttgttttcatcatttaagcacagtcttgtgatgatgagaacataagtgtgattcttttctgtattttgaggtccctaatccaaagcccattttgctaggattttttctgctatcagatgtgttttcactctaaacctagtcttttatgacatgaattgattacttcctgttaattttctatcctcccttactatcctccttttttgttttcagtattcagtatttcagtattctagagtagattttgatataaaagaaaataattcttacatcatcttttgcaacaaattttgttttctgaattgataataaatttaaaaagttgattcctattttcacatatgttcatatgcccctatgtttgggggtatcactcagttttcccttttttgtgtaaagatgttttgtaaaacaaaattgtctcaaagtgattatattatatatataaaaagtaacagattttaacaaaggttaaaagattcttggggtaacagattcttctggggcttggaaatcttccatttctcttgagggttttttttaatgagtgttaaatatgttaaaatttttatttctacctcatgtgtttttttaaattattacttgaagttttttatttaataaattttttctactaatgga

SEQ ID NO: 439786 - DNA, 4394 bp, Homo sapiens
gttggcgcatgcgcgcgaggtgcgcaggctcgcgcctttttcccttttctaagctttctgtgttacccccggttccgctgtcttttctgtctacagtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagcatctgaagcaaacacacttagaatatttcagcctttggtgtctaatgttaaccctggagtcacaatcgaaggataataaaaagaatcaccaaaatatctggctaatgcctgcttcggaaatggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacagaaacttgtcggtccttccagaatcaactttgttcagattagaccaagaagaaaaaaattgtgatatagataccccattaggaaatctttccaaattgatggaaaacacgtttgtcagcaaaaaacttcgagatttaattattgactttcgtgaacctcagtttatatcctaccttagttctgttcttccacatgatgcaaaggatacagttgcctgcattctaaagggtttgaataagcctcagaggcaagcgatgaaaaaggtacttctttcaaaagactacacactcatcgtgggtatgcctgggacaggaaaaacaactacgatatgtactctcgtaagaattctctacgcctgtggttttagcgttttgttgaccagctatacacactctgctgttgacaatattcttttgaagttagccaagtttaaaataggatttttgcgtttgggtcagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaaggtaggcagacacttaagtgttaattttaaactagattattttcaaggaacagatttagtacactgataaacatgaatctgatttattgacagagctcttggcatgagtgaaagcttattcaagaggctggagcagaataagagtgctgttgtacagttaaccgtgcagtacagaatgaacaggtatttgtaacagtgttagctaggagtggttttcatgtttgtttccatctaccaaaactaaagttatcttttgtaattcccttagtaaaattatgtccttaagtaataagctgacctatgagggcaagctggagtgtggatcagacaaagtggccaatgcagtgataaacctacgtcactttaaagatgtgaagctggaactggaattttatgctgactattctgataatccttggttgatgggagtatttgaacccaacaatcctgtttgtttccttaatacagacaaggttccagcgccagaacaagttgaaaaaggtggtgtgagcaatgtaacagaagccaaactcatagttttcctaacctccatttttgttaaggctggatgcagtccctctgatattggtattattgcaccgtacaggcagcaattaaagatcatcaatgatttattggcacgttctattgggatggtcgaagttaatacagtagacaaataccaaggaagggacaaaagtattgtcctagtatcttttgttagaagtaataaggatggaactgttggtgaactcttgaaagattggcgacgtcttaatgttgctataaccagagccaaacataaactgattcttctggggtgtgtgccctcactaaattgctatcctcctttggagaagctgcttaatcatttaaactcagaaaaattaatcattgatcttccatcaagagaacatgaaagtctttgccacatattgggtgactttcaaagagaataaaacactatttcccttgccttttcatactagggcagtatctcctctagctagtgcccatacagaaaattctatcaccatacaaaatttaatgcagtatttatgttttaaagcacaggtgtaccgaaaactgtgaaaagtctgaatttatgggttctatgcatgcatttttgcctaacctagagaaagagtttgataaatttttaccagctttgaagatggattaacttttgactttgagctttaaacttttaagtcagacatttcaggactaatttgattttgtagatatcattgtaagaactttatttgaaagactgaataaagggatttgatttgttttcatcatttaagcacagtcttgtgatgatgagaacataagtgtgattcttttctgtattttgaggtccctaatccaaagcccattttgctaggattttttctgctatcagatgtgttttcactctaaacctagtcttttatgacatgaattgattacttcctgttaattttctatcctcccttactatcctccttttttgttttcagtattcagtatttcagtattctagagtagattttgatataaaagaaaataattcttacatcatcttttgcaacaaattttgttttctgaattgataataaatttaaaaagttgattcctattttcacatatgttcatatgcccctatgtttgggggtatcactcagttttcccttttttgtgtaaagatgttttgtaaaacaaaattgtctcaaagtgattatattatatatataaaaagtaacagattttaacaaaggttaaaagatttttaatgagtgttaaatatgttaaaatttttatttctacctcatgtgtttttttaaattattacttgaagttttttatttaataaattttttctactaatgga

SEQ ID NO: 439787 - DNA, 2873 bp, Homo sapiens
gttggcgcatgcgcgcgaggtgcgcaggctcgcgcctttttcccttttctaagctttctgtgttacccccggttccgctgtcttttctgtctacagtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagcatctgaagcaaacacacttagaatatttcagcctttggtgtctaatgttaaccctggagtcacaatcgaaggataataaaaagaatcaccaaaatatctggctaatgcctgcttcggaaatggagaagagtggcagttgcattggaaacctgattagaatggaacatgtaaagatagtttgtgatgggcaatatttacataatttccaatgtaaacatggtgccatacctgtcacaaatctaatggcaggtgacagagttattgtaagtggagaagaaaggtcactgtttgctttgtctagaggatatgtgaaggagattaacatgacaacagtaacttgtttattagacagaaacttgtcggtccttccagaatcaactttgttcagattagaccaagaagaaaaaaattgtgatatagataccccattaggaaatctttccaaattgatggaaaacacgtttgtcagcaaaaaacttcgagatttaattattgactttcgtgaacctcagtttatatcctaccttagttctgttcttccacatgatgcaaaggatacagttgcctgcattctaaagggtttgaataagcctcagaggcaagcgatgaaaaaggtacttctttcaaaagactacacactcatcgtgggtatgcctgggacaggaaaaacaactacgatatgtactctcgtaagaattctctacgcctgtggttttagcgttttgttgaccagctatacacactctgctgttgacaatattcttttgaagttagccaagtttaaaataggatttttgcgtttgggtcagattcagaaggttcatccagctatccagcaatttacagagcaagaaatttgcagatcaaagtccattaaatccttagctcttctagaagaactctacaatagtcaacttatagttgcaacaacatgtatgggaataaaccatccaatattttcccgtaaaatttttgatttttgtattgtggatgaagcctctcaaattagccaaccaatttgtctgggccccctttttttttcacggagatttgtgttagtgggggaccatcagcagcttcctcccctggtgctaaaccgtgaagcaaggtaggcagacacttaagtgttaattttaaactagattattttcaaggaacagatttagtacactgataaacatgaatctgatttattgacagagctcttggcatgagtgaaagcttattcaagaggctggagcagaataagagtgctgttgtacagttaaccgtgcagtacagaatgaacaggtatttgtaacagtgttagctaggagtggttttcatgtttgtttccatctaccaaaactaaagttatcttttgtaattcccttagtaaaattatgtccttaagtaataagctgacctatgagggcaagctggagtgcagtggtgcaatctcctggtgtctcagaaaaaaaaa

SEQ ID NO: 439788 - DNA, 1433 bp, Homo sapiens
gttggcgcatgcgcgcgaggtgcgcaggctcgcgcctttttcccttttctaagctttctgtgttacccccggttccgctgtcttttctgtctacagtttgcgatccccgcgtccaggatggagcagctgaacgaactggagctgctgatggagaagagtttttgggaggaggcggagctgccggcggagctatttcagaagaaagtggtagcttcctttccaagaacagttctgagcacaggaatggataaccggtacctggtgttggcagtcaatactgtacagaacaaagagggaaactgtgaaaagcgcctggtcatcactgcttcacagtcactagaaaataaagaactatgcatccttaggaatgactggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttaggagctctgatccagccacacgccaaatgctaattggtacggttctccatgaggtgtttcaaaaagccataaataatagctttgccccagaaaagctacaagaacttgcttttcaaacaattcaagaaataagacatttgaaggaaatgtaccgcttaaatctaagtcaagatgaaataaaacaagaagtagaggactatcttccttcgttttgtaaatgggcaggagatttcatgcataaaaacacttcgactgacttccctcagatgcagctctctctgccaagtgataatagtaaggataattcaacatgtaacattgaagtcgtgaaaccaatggatattgaagaaagcatttggtcccctaggtttggattgaaaggcaaaatagatgttacagttggtgtgaaaatacatcgagggtataaaacaaaatacaagataatgccgctggaacttaaaactggcaaagaatcaaattctattgaacaccgtagtcaggttgttctgtacactctactaagccaagagagaagagctgatccagaggctggcttgcttctctacctcaagactggtcagatgtaccctgtgcctgccaaccatctagataaaagagaattattaaagctaagaaaccagatggcattctcattgtttcaccgtattagcaaatctgctactagacagaagacacagcttgcttctttgccacaaataattgaggaagagaaaacttgtaaatattgttcacaaattggcaattgtgctctttatagcagagcagttgaacaacagatggattgtagttcagtcccaattgtgatgctgcccaaaatagaagaagaaacccagatatatacaggggccggctcgat

SEQ ID NO: 439789 - DNA, 2193 bp, Homo sapiens
cctcgctgtacatggcccagcagggcactatgggggtcaggcctgcagcactcacacttggcacctgctccaaaaccctttcaggtctttgaggatctgagccctggcctgggtctcccgccggctcggaaaagctggcctgccgggcagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtacaaaaa

SEQ ID NO: 439790 - DNA, 2935 bp, Homo sapiens
cctcgctgtacatggcccagcagggcactatgggggtcaggcctgcagcactcacacttggcacctgctccaaaaccctttcaggtctttgaggatctgagccctggcctgggtctcccgccggctcggaaaagctggcctgccgggcagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtacaaaaaaaaaaaaaaaaaaaaaaaaaaaaaaaaaaacaaagaaagaaaaagaaaagaaaaagagaaagaaaaaaaaaaaaaagagaaagaaaaaaaaaaaagggggggggcggccacgaagcaacaaaaagaaaagaaaaaaagaacgacaacgaagaggaagcaacggagagacaacaaggataacgagaacaacaagaggtgaaacaaaaagtagcaaaaagagagatgcagggggtagaaaaagagcaaggaggggggacccccacagagaaaaaaaaagcggcggcagggaaaacacccagagagaagggagaaaaaacaaaacgaaagagagagaaactgcacaaacccacaaacggagggaactacacacggacgaagaaaagaaaaaaggaaacaacccaaaacacaaaaacaaaagcaagcagcacagagcagcgagagaaaacaaacgaagaagcaggaggacgaaagcaggatggacgaggcggccggggaggccgaaaggggaaagaagaaaaaacggaaggaggagagagaacggaagacaaagcgagcacgagaaaagagacccagcgagacagcaaaagcgagaaagaggcgagaggaagaagaagaggagaggaggaagaacagcacgagagagacagcagaggaggaaggaacagggaacgaggaagagaggccacgaagagggcagcgagcacgagaagagagatcgaaggcgagaggcaggacaaaagaa

SEQ ID NO: 439791 - DNA, 2103 bp, Homo sapiens
cctcgctgtacatggcccagcagggcactatgggggtcaggcctgcagcactcacacttggcacctgctccaaaaccctttcaggtctttgaggatctgagccctggcctgggtctcccgccggctcggaaaagctggcctgccgggcagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccctgcgaacctatgagggatcctctagatcacctcac

SEQ ID NO: 439792 - DNA, 1637 bp, Homo sapiens
aagtcaagtaagggaatgcctcccacccttgctattttctctaaatagagaggctgagtacagacgcggaaagaaacaaggaggtgtgggagcagcccgccatgctagagaaagactacattcctgccactaacagtcggtggccactgggcaaatcttaagtctgtggtgcctcagtttcctcatatgcaaagcgggtttgttccataggcctctgaggacaaaatgagattgcagaagtgagattgcagatggttagaaaagacaaagccacactggtgtgagttttcatggtccccgggaccacatcctcagaaggatccctcccacttctcctgggggttcctgcagttctgggacaggggcattccctgcagaccagacgtgaatgaagccgcttagccagcatcttgtgaacggcctgcctcatgtcctgagccacttacacatgtgttttttctccccagggtctacgaagaatagggtgaaaaacctcagaagggaaaactccaaaccagttgggagacttgtgcaaaggactttgcagattaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtacaaaaa

SEQ ID NO: 439793 - DNA, 2147 bp, Homo sapiens
cctcgctgtacatggcccagcagggcactatgggggtcaggcctgcagcactcacacttggcacctgctccaaaaccctttcaggtctttgaggatctgagccctggcctgggtctcccgccggctcggaaaagctggcctgccgggcagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaatactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtacaaaaa

SEQ ID NO: 439794 - DNA, 1868 bp, Homo sapiens
cctcgctgtacatggcccagcagggcactatgggggtcaggcctgcagcactcacacttggcacctgctccaaaaccctttcaggtctttgaggatctgagccctggcctgggtctcccgccggctcggaaaagctggcctgccgggcagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacactcgagggccgcacgggaagaaagacccggagtccggaaggagaacaactcgggagaggggccgcacggggagaaagacccggagtccggaaggagaagaactcgggagaggggccgcgcggggagaaagaacgggagacactcgagtgtctccggaatcgggggtagctgttcgattata

SEQ ID NO: 439795 - DNA, 256 bp, Homo sapiens
aaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgag

SEQ ID NO: 439796 - DNA, 2111 bp, Homo sapiens
cctcgctgtacatggcccagcagggcactatgggggtcaggcctgcagcactcacacttggcacctgctccaaaaccctttcaggtctttgaggatctgagccctggcctgggtctcccgccggctcggaaaagctggcctgccgggcagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccacgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtacaaaaa

SEQ ID NO: 439797 - DNA, 1390 bp, Homo sapiens
gcatcaggacgactctagtagtatccccttagtctgagcgacgttgaataatcatgtaaattgaagccaatacgatacgctgctctgtgagagataccattgttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtacaaaaa

SEQ ID NO: 439798 - DNA, 1923 bp, Homo sapiens
cctcgctgtacatggcccagcagggcactatgggggtcaggcctgcagcactcacacttggcacctgctccaaaaccctttcaggtctttgaggatctgagccctggcctgggtctcccgccggctcggaaaagctggcctgccgggcagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgctatgtacatgtcagaaaccattagcattgcatgcaggtttcatattctttctaagatggaaagtaataaaatatatttgaaatgtacaaaaa

SEQ ID NO: 439799 - DNA, 1257 bp, Homo sapiens
cctcgctgtacatggcccagcagggcactatgggggtcaggcctgcagcactcacacttggcacctgctccaaaaccctttcaggtctttgaggatctgagccctggcctgggtctcccgccggctcggaaaagctggcctgccgggcagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaagcctttctttctcacaggcataagacacaaattatatattgttatgaagcactttttaccaacggtcagttttcgacagggtattgccacgtcacgacgcgatgaacaacggagagacatcgatctgc

SEQ ID NO: 439800 - DNA, 1043 bp, Homo sapiens
agtttgaaacatctagtctttctaggtgtttaaaagtgtacaacagcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439801 - DNA, 5155 bp, Homo sapiens
acgcggcagccacaaacggatgtgaggtgaggcaggagcggcgacctttgaaggaaaaaaggaagtgtttggacgacagcgagcgggagaagcggggtcaaagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439802 - DNA, 5158 bp, Homo sapiens
agatagagatgttttaaaggcttctgggtttgatttcttagtcagatgctgtggtacttggcatttaacaactagaattcagaatccagatttttaaaggtgaattattttaaataactgagttgtaatagagaagtaatttatttgaaattattttaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439803 - DNA, 5167 bp, Homo sapiens
  misc_feature (39)..(39): n is a, c, g, or t
  misc_feature (42)..(42): n is a, c, g, or t
  misc_feature (49)..(49): n is a, c, g, or t
  misc_feature (66)..(66): n is a, c, g, or t
  misc_feature (72)..(72): n is a, c, g, or t
  misc_feature (74)..(74): n is a, c, g, or t
tccaagcatcagaacgtgataaagcggggaacataatgncanccggtgnaaatatcgagacacatntaacgngntccggtgtgagcaacggcgggctggagaagcggggtcaaagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439804 - DNA, 5984 bp, Homo sapiens
  misc_feature (5575)..(5575): n is a, c, g, or t
aagagtggtatcaacgcagagtcgccattacggccgggggaaggaaaaaaggaagtgtttggacgacagcgagcgggagaagcggggtcaagtaggtaggggtgcggtgcgggaggggcaggcgggctccggcgtgcgagggccttggccagcggagcgtttcgcggctccgtgtcgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaatttgcagttttgtcttattaaagtggtatgtttttcagtgtattttttctgaagttgatctctttacatttcagctattactgtatgcaggaagaaactgacttgtaatctttgattttttttttttttttgcatttgtaaaggctttgtacttaaggtaggattaaatgtttgcagattgtgaaaaaaaaaaaaaaaaaaaaaaaaaaaaaaaaanaaaaaaaaaaaaaagggggggggggggcaataaaaataatccccgagggggggcgacaagattttaggcacacccaggtttttgtggtcgaaacaggggtggccccacataaggaggagcacacaataaaatacgagcagagacggagcaggcaccggttgaaaaaccacgcgctgagagagacgggaaaccaactgcagcacacggcggaatcactggggaaggaggacccccaaatcgtgcgggggcgggggcacagtatgtgcgggacagcacacaccacaagaaagtaaagccccgcgcatgaaaacatataaacacagagcggcgactcatggggcgcaaccaacagacggaagtagctggcgcgagaacagatactgacaaagaatactatgaaaaaatttag

SEQ ID NO: 439805 - DNA, 5800 bp, Homo sapiens
  misc_feature (5391)..(5391): n is a, c, g, or t
aagagtggtatcaacgcagagtcgccattacggccgggggaaggaaaaaaggaagtgtttggacgacagcgagcgggagaagcggggtcaagtaggtaggggtgcggtgcgggaggggcaggcgggctccggcgtgcgagggccttggccagcggagcgtttcgcggctccgtgtcgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaaaaaaaaaaaaaaaaaaaaaaaaaaaaaaaaaanaaaaaaaaaaaaaagggggggggggggcaataaaaataatccccgagggggggcgacaagattttaggcacacccaggtttttgtggtcgaaacaggggtggccccacataaggaggagcacacaataaaatacgagcagagacggagcaggcaccggttgaaaaaccacgcgctgagagagacgggaaaccaactgcagcacacggcggaatcactggggaaggaggacccccaaatcgtgcgggggcgggggcacagtatgtgcgggacagcacacaccacaagaaagtaaagccccgcgcatgaaaacatataaacacagagcggcgactcatggggcgcaaccaacagacggaagtagctggcgcgagaacagatactgacaaagaatactatgaaaaaatttag

SEQ ID NO: 439806 - DNA, 5415 bp, Homo sapiens
aagagtggtatcaacgcagagtcgccattacggccgggggaaggaaaaaaggaagtgtttggacgacagcgagcgggagaagcggggtcaagtaggtaggggtgcggtgcgggaggggcaggcgggctccggcgtgcgagggccttggccagcggagcgtttcgcggctccgtgtcgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaagagtgaacacaacatgctcccttggtctctgcaaccatcgattcctaacagcctagaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439807 - DNA, 5026 bp, Homo sapiens
gtacggcatatgtgaccaggcgtcgaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439808 - DNA, 5202 bp, Homo sapiens
aagagtggtatcaacgcagagtcgccattacggccgggggaaggaaaaaaggaagtgtttggacgacagcgagcgggagaagcggggtcaaagggagcactatgtctgcggaagtccccgaggcagcctccgcggaggagcagaagagtgaacacaacatgctcccttggtctctgcaaccatcgattcctaacagcctagaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439809 - DNA, 5305 bp, Homo sapiens
aagagtggtatcaacgcagagtcgccattacggccgggggaaggaaaaaaggaagtgtttggacgacagcgagcgggagaagcggggtcaagtaggtaggggtgcggtgcgggaggggcaggcgggctccggcgtgcgagggccttggccagcggagcgtttcgcggctccgtgtcgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcatggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439810 - DNA, 5042 bp, Homo sapiens
  misc_feature (12)..(12): n is a, c, g, or t
attatggccggnacgacagcgagctggattttcggggtcaaagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcatggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439811 - DNA, 4112 bp, Homo sapiens
aagagtggtatcaacgcagagtcgccattacggccgggggaaggaaaaaaggaagtgtttggacgacagcgagcgggagaagcggggtcaagtaggtaggggtgcggtgcgggaggggcaggcgggctccggcgtgcgagggccttggccagcggagcgtttcgcggctccgtgtcgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaggcaggagaactggcatgaacctgggaggcaaagctgcagtgagccgagacaaggccatggcacctcaagactgggcaacagagcagatccgttcaaaaaaaaaagaaagaacaagatggggcctattcgggaggacaagggaccacggcggaatctcacattggaaggcaggcagggaccacagcgaaaagaaacatccggtaacagaacccgtctgtacattaaaataggaaggggggcgtaccaacggaaaagcgaagagggaaagaggagcaacagagaattca

SEQ ID NO: 439812 - DNA, 2398 bp, Homo sapiens
aaacagtcatacatcgagagacagaaaattaactgaaaagcagtttagagactgggggaggccggatctctagagccatcctgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439813 - DNA, 1829 bp, Homo sapiens
  misc_feature (1434)..(1434): n is a, c, g, or t
  misc_feature (1451)..(1451): n is a, c, g, or t
aagagtggtatcaacgcagagtcgccattacggccgggggaaggaaaaaaggaagtgtttggacgacagcgagcgggagaagcggggtcaagtaggtaggggtgcggtgcgggaggggcaggcgggctccggcgtgcgagggccttggccagcggagcgtttcgcggctccgtgtcgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcaaaaaaaaaaaaaaaaaaaaaaaaaaaaaaaaanaaaaaaaaaaaaaacanaaagaacaaagacacagcaataaaaggcatagaatgagaactaaacaagataacaaacacaaaaaagaagggggggggggcaaataaagctactcccaggagggaacgaaatagcacagcaacacgagtatagtgaaaaagaaggggcgacaacaagggagacggtataaatacagagcaggcgcgggagcacagaaaacaaactggcgcagagacaaaagcgctcggaggtcgtagagaggagagaacacaacttggggagtggagataagagaacaacaaaccacgaaaatagtgcagaggaagataataaaaaaggagagatggggaacacacacaatggcggaaaaagtaatcagggagatgtagaatacacgg

SEQ ID NO: 439814 - DNA, 1183 bp, Homo sapiens
actcctagaggatcccaactacacagctatccacgtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439815 - DNA, 966 bp, Homo sapiens
  misc_feature (557)..(557): n is a, c, g, or t
cgaggtgacctagaggttcccgattgcattgtcttccctaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaatttgcagttttgtcttattaaagtggtatgtttttcagtgtattttttctgaagttgatctctttacatttcagctattactgtatgcaggaagaaactgacttgtaatctttgattttttttttttttttgcatttgtaaaggctttgtacttaaggtaggattaaatgtttgcagattgtgaaaaaaaaaaaaaaaaaaaaaaaaaaaaaaaaanaaaaaaaaaaaaaagggggggggggggcaataaaaataatccccgagggggggcgacaagattttaggcacacccaggtttttgtggtcgaaacaggggtggccccacataaggaggagcacacaataaaatacgagcagagacggagcaggcaccggttgaaaaaccacgcgctgagagagacgggaaaccaactgcagcacacggcggaatcactggggaaggaggacccccaaatcgtgcgggggcgggggcacagtatgtgcgggacagcacacaccacaagaaagtaaagccccgcgcatgaaaacatataaacacagagcggcgactcatggggcgcaaccaacagacggaagtagctggcgcgagaacagatactgacaaagaatactatgaaaaaatttag

SEQ ID NO: 439816 - DNA, 1139 bp, Homo sapiens
aagagtggtatcaacgcagagtcgccattacggccgggggaaggaaaaaaggaagtgtttggacgacagcgagcgggagaagcggggtcaagtaggtaggggtgcggtgcgggaggggcaggcgggctccggcgtgcgagggccttggccagcggagcgtttcgcggctccgtgtcgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaagagtgaacacaacatgctcccttggtctctgcaaccatcgattcctaacagcctagaggtaaacctcagaaaagtttttaaatgtttctcttagccgtcttagcagtttgcgatacaacagtttgttagggttgcttcttttgtttgtgcaagacttgaatacttaacttctaatccagaagctgtgtttactataacataaaatattaaagatgagctgatggtgaaatcctcaagtgtgaagaaagtttcttagctttatagctttatggaaacaagtacattgtattttttcattcagatgaatgaacttttattgaacattcattaaatgctaggcactaggcaaacaaagacttaatagaatgacaacagtaattttccatagagcttgatacagtattggtaccttcctggcagtatcccaaaggatttgttggctttcattaatcctttctagttattcgtcaatcagtgcatcagtcaacatgttgctgagcagatagaggagaatttgcttagagtggtcagatttttattgctgacgttgctgtataaccctcctctgccgaaggctgaaaagtggtatcagtcattgagacataattctgctcagtgtataatagactacaaaataatccttagttatttgagtgtcctttttacgtgtatatatttataacttataccccacctattcacagaaaggatttctgatgtatttcagtggtacaattcacaaaaatgcacatgccgagacaataactattattaaaaatac

SEQ ID NO: 439817 - DNA, 542 bp, Homo sapiens
gactcaccaaactaatatgtcttggaaaggatacccacaggaaagctgtcaatgaaattatttgtcaggtaagagatacaggttggtgcctttatgagtggtagaagaggaaaagaacctttatctgcattattttaatatatcaaccataaagagatataaattgttttcccatgcttccagtattttaaaaataggagttcatattggtattttcaggagctcttttgacaactacttttggttacctaaaggctgaagaatgtttttgttatgtttgagacagggtcttactctgtcgcccaggctggggtgcaatggcacaatgatagcatattgccgccttgaactcctgggttcacctagcctcccacctcagcctccaagtagctgggactgcaggtgtgagcaaccgcctcatccatgttttctatttctattcagagtgaacacaacatgctcccttggtctctgcaaccatcgattcctaacagcctagaggtaaacctcagaaaagtttttaaatgtttctcttagccgtc

SEQ ID NO: 439818 - DNA, 5358 bp, Homo sapiens
aagagtggtatcaacgcagagtcgccattacggccgggggaaggaaaaaaggaagtgtttggacgacagcgagcgggagaagcggggtcaagtaggtaggggtgcggtgcgggaggggcaggcgggctccggcgtgcgagggccttggccagcggagcgtttcgcggctccgtgtcgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439819 - DNA, 5145 bp, Homo sapiens
aagagtggtatcaacgcagagtcgccattacggccgggggaaggaaaaaaggaagtgtttggacgacagcgagcgggagaagcggggtcaaagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439820 - DNA, 5100 bp, Homo sapiens
acgcggcagccacaaacggatgtgaggtgaggcaggagcggcgacctttgaaggaaaaaaggaagtgtttggacgacagcgagcgggagaagcggggtcaagaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439821 - DNA, 5541 bp, Homo sapiens
gagccctgggccctgcccaaggccgggtctggcgggcggcctgctcccgccaggcggagggccgcgcccgagatgcggggccgaggcgcatgaggccgaggctcctgcgccccacctttggcttcccgccgtcgctggctggtgcgccgacgaattgggagttccaacgtgccccgcgtttactccgaatcgtgccttttgtaacacctccgtgggtcgcggtgttcctcagtcacttatatttacgcgagagcccaggacgcaggctttgggcgtagagcctaagtttttctgtaagcctcaatttggttaggaagttttattttttcctttgaagaactctccaactacttgtattgtgagcgtgcggttcactccaaaagcagtgcctcgtgtgcgggccgcgatgtgggccaggattggcatttcagggccaacccttgtaaccatggtcagtgagtaaagtccggcctttagtgtcttcacctgtaaaggccgaatactggtgcttgcctcccacggcggggtgaggcctagaggaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439822 - DNA, 5147 bp, Homo sapiens
aagagtggtatcaacgcagagtcgccattacggccgggggaaggaaaaaaggaagtgtttggacgacagcgagcgggagaagcggggtcaaagtgaacacaacatgctcccttggtctctgcaaccatcgattcctaacagcctagaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439823 - DNA, 5308 bp, Homo sapiens
aagagtggtatcaacgcagagtcgccattacggccgggggaaggaaaaaaggaagtgtttggacgacagcgagcgggagaagcggggtcaagtaggtaggggtgcggtgcgggaggggcaggcgggctccggcgtgcgagggccttggccagcggagcgtttcgcggctccgtgtcgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttgtttgcttttgtaaacgctatgagtggcagtatgtgaattgcaataccttccaattttttgtttaaataatggtttccattc

SEQ ID NO: 439824 - DNA, 5321 bp, Homo sapiens
aagagtggtatcaacgcagagtcgccattacggccgggggaaggaaaaaaggaagtgtttggacgacagcgagcgggagaagcggggtcaagtaggtaggggtgcggtgcgggaggggcaggcgggctccggcgtgcgagggccttggccagcggagcgtttcgcggctccgtgtcgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgttactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtcttgaactcctgacctcaggtgatccactcgcctcggcctcccaaagtgctgggattataggcatgcgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaagatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaatatcctcgattcaaacatacagacctaccaacttctatgaatcccccttccacacactcgggggcggccc

SEQ ID NO: 439825 - DNA, 1401 bp, Homo sapiens
aagagtggtatcaacgcagagtcgccattacggccgggggaaggaaaaaaggaagtgtttggacgacagcgagcgggagaagcggggtcaagtaggtaggggtgcggtgcgggaggggcaggcgggctccggcgtgcgagggccttggccagcggagcgtttcgcggctccgtgtcgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctca

SEQ ID NO: 439826 - DNA, 570 bp, Homo sapiens
  misc_feature (19)..(19): n is a, c, g, or t
atctcgtgtccttcggagnttgcctgcgacgtttccaggcgcatcatccacatccagatcataggccagttctgcaaggaagcggagctgattcttcacttttatcattccattccagcgtagccaaccgtggactagtatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaa

SEQ ID NO: 439827 - DNA, 1164 bp, Homo sapiens
tggagtcctgttagagattcagtagatggagccaccttcatgttgcccctcactgagctgctctgctcacctctagatgctccccatggctgtttcatagccctctgtaccacatccccatgtactttttcatatcaacggtaagtacctcaaattaccgtatgtatttacttgttcataaggttgatgtctgtaactctttgaaggttgtattagtcgtttgctcctatattactaatgatgacaaagtcgcctgacagagtagatgttcaaatttatggacttaaactgactgacatcttgataatgcccatatccagaggtactccagatattatatcttcatgcagaaaactgaaagatacctttagctacatctaccccagaatgagtgtccaaagcaggtggcaccaccaaaaggcaccttcttttcccatgaaaagagggaagagagttgagaagcctcactcccatccctgctctgccactgacaagttgtgtggcatttggcacatcatgttctctctctacatgcgcctaaaatgacgggtagggtcagagacattggaggatctctcttttctcttccacctctaacacggtaagatcttagcaaagtaaaaaggacagtgataacagaaaaattgttcctctaagagtcccaagtcatcttttttctctccgtgtgtgttagcatttgtgtgtgtctgtgggtgtgtatgcatgtgtgtggaagctatacaaggaaagctgaatccatatgtagacttcatggagactagtactgctccaaatgtgcacaagccatgtgatatggtttgcctctgtgtccccacccaaatctcatgttgaaatgtaatccccaatgctggaggtgggacctggtgggaagattggatcatgggggagttttctcatgatttaacaacatccgccctttgttgtcatgatagtgagttcttgtgagatctggttgtttaaaaatatgtgacacctccccccaccttccttctgctctggccatgtaaagtgctcactccccctttgccttccaccatgattgtaagtttcctgaagcctccctagaagctgagcagatgccagcatcatgcttgctgtgcagcctgcagaactgtgagccaattaaacctctttatgaattat

SEQ ID NO: 439828 - DNA, 397 bp, Homo sapiens
actgttaacattgtgaaccacttgaccctagtgttgcatcttcacaaaaaagagcaatgtgccgtcttctgtctttggaaaatgggacaagcttgctcctgatactaggttttagaagcatacagacttggttttagtactggctttgttctttactaactctgaacaattaaatgagcagatggtctacagggcttagtacagtgcctgacacatagtaagcacttagaaatggtagcttctgactgttgtgctggagtcctgttagagattcagtagatggagccaccttcatgttgcccctcactgagctgctctgctcacctctagatgctccccatggctgtttcatagccctctgtaccacatccccatgtactttttcatatcaacggta

SEQ ID NO: 439829 - DNA, 1028 bp, Homo sapiens
atgggtgtctggggagggtcaagggctggggctgagctttaaaatggttccgacttgtccctctctcagccctccatggcctggcacgaggggatggggatgcttccgcctttccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgtgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaacttttttccgttatcacccaggcctgattcactggccttggcggagatgcttct

SEQ ID NO: 439830 - DNA, 2475 bp, Homo sapiens
gggccctacagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagcatgttctaggcactgaagacatatcgattaatcctcacaataatattaatgagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtggtaatgatgttatgcaacttgctgtgcctcagatggactggggcacacctcactcttttgctaacaattcacataatgcatgcagggaattccttctgttttttagttcctgtctcagcagctgacctagacagggtactgtattagctagtgtctcattaatacctgatcagggcagaaaactgatagaatgggtattcctttcaattgaaaataatggtcagttcctcagcttttcatgaaatgatatgggagcagctcatatcataatgtctgaaatatttatttattcatctgtctaattcacccttttcttttaaaagccccagtttcagaatgtgaatcagggatattcctgttactaaaatggaaatgtaattccaagtttcttttttaattttttaaatttatgtcattgtattggactatgcttatatttaaaactacttaatttagagttaactacctgcttaggccccagaacattacttatgcccttcagttaccaaaagatttgtgcaaggttttgtaccctggtaaatgatgccaaagtttgttttctgtggtgtttgtcaaatgttctatgtataattaactgtctgtaacatgctgtttccttcctctgcagatgtagctgctttcctaaatctgtctgtctttctttaggttagctgtatgtctgtaaaagtatgttcaattaaattactccatcagacacttgtctgtcttgcaatgtagaagcagctttgtagcaccttgttttgaggtttgctgcatttgttgctgcactttgtgcattctgaacatgaatgtaacattagatattaagtcattgttataaggggttgaatttaaatcctgtaagtcaaaattgaaagggtgttattaagtgtgcctttattttgcatgaaaataaaaagaattatacgtaaagca

SEQ ID NO: 439831 - DNA, 1396 bp, Homo sapiens
tcaacatattgaaacattagatacctgcatttgagatgaaaatgttatctctggattgtttggttataatattctcttttggtgttttagtaggattttttttctaaacaaagtaaaatatttctttgtagtaattttgtctgattttccatattaaatgaaacaaatacattcatacatttataagtaaaatgttccaaatgggtgggatttttttgtttgctttattaccattcagctatccttttcaggttgcctgaagctagaaagatcttaaattctcaatttgtttgaactttaaaaacctagaaaattgctcattgccattctgtgtttcctctaaaaactgagttttcacaattttggatttagtaaaaatgtatgttcatcattggattataaagtaaaacaaacattctggaaagaatctggaaatttcattagtaatgtgaagacctgactatagttatagttctacataacagtgttaaaaacaaaacctatgttattattaaaaattagttccttcctccctctaccagccctgattccactcacccccgatctcccttcctcttaatatttttctgcttttatgtattttatatttttaaggctaatgacaaatagttacttatctattaagttattgatgttcaacttatcttgcagctgctgtattaaagtatgaaaataatgtgatgaatattcgacagtttaactgttctccacatccttactggttgcctaattttatggatgtcttcacgtggtctttaccgtttgttggagaaaaaggtataatttttatttttaaaaaaaatttgttttattactgttacatttactccagtttactatcataggcacatacttgctaaaggaaaccaaagtctagtttcactgtggttacagctctccttgtgtcagtgggtgtggacataagagtctcaaagatattttagttagctgtttacagcccccatgtgaggctgtctgggggactgggagaagatttataaatagcccaatgtcttcagctgttggattttctttttttttttttctttagcttaaatcttttatgaaggggtggagagattgctttgcttgaaatgggcccttctgcatatcttaacaccatttttgggcattccaccgaaattcttggggaaatttagtagccttcattttagcaatattagtcattttaatagctgttctatactttaagagaaatcataaagagaaattcagattgtaacccaatattccttctcttatataaaaaatatgtataaaattttagtagtgatgcctttctaatttagaggaacacttgttagtacataataggctttttgagagaaaataaatgctatttaagaaattctgt

SEQ ID NO: 439832 - DNA, 330 bp, Homo sapiens
accactgccaagttaaatctctatctttttatttgtcccaaccaccttttctccatcattcacttccttttttctggactctccatctgaagaacggctcatatatggcaataaaaaaggtacagaccagacagagtaacattgttttgaaatatgacttcataagttatcttcatgtccatgtaagttagcacattcattgagtaatgtctatgcagagtcctcttgggccttgtgcaaatttagcttaagttttatctgtgttagtgtttggtatttttagaagtcatattccaagatatctgtctttctgtgcatggaaatattttc

SEQ ID NO: 439833 - DNA, 324 bp, Homo sapiens
atttattgtacttcatttaaggtaaagaatatctaatactataatacaatattttgagagttctgcctaaaaatgttttggcttaaacaaaaaagttttggttatcctgaaagaacttaattttgtgagacaactcatttctctaataattctcaacaaagaacatgttagtataaatagctttaaaagtggtataatttgcttactatttagaaaaacacttctacccaataaatgaagaagaaagaaaaatccctgctttacagtttttagtcttatctagatccaattattagtttttaagttaatgtatttttggtgact

SEQ ID NO: 439834 - DNA, 3131 bp, Homo sapiens
gggccctacagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctccta

SEQ ID NO: 439835 - DNA, 3511 bp, Homo sapiens
gggccctacagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctcctatctctgtgttgggttttatttggaagatgcaatctgatttgtccttttgatgcaaatcagaaaatcctgttactagagctgggatgtcctccggagattatctcgtggatagttcatggtaatttgattaattaaattctttataaattttgccttaaaaaaaacttttgttatatacttgttttacatgagcattagtaactgagcactagaggactttgaatgcctactgtaggcctcctaagtctaatatttaagatcactgtttattgtcttttaattgaaagaaaatatgttattgtctagaattttgttatagtggtattgggaatttactgggtgttctaacaataagaaaaatattagtgataattgcattt

SEQ ID NO: 439836 - DNA, 2290 bp, Homo sapiens
tgctgaggtcgctctagagtatcccggctatcacattatccattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctccta

SEQ ID NO: 439837 - DNA, 2705 bp, Homo sapiens
tcaacatattgaaacattagatacctgcatttgagatgaaaatgttatctctggattgtttggttataatattctcttttggtgttttagtaggattttttttctaaacaaagtaaaatatttctttgtagtaattttgtctgattttccatattaaatgaaacaaatacattcatacatttataagtaaaatgttccaaatgggtgggatttttttgtttgctttattaccattcagctatccttttcaggttgcctgaagctagaaagatcttaaattctcaatttgtttgaactttaaaaacctagaaaattgctcattgccattctgtgtttcctctaaaaactgagttttcacaattttggatttagtaaaaatgtatgttcatcattggattataaagtaaaacaaacattctggaaagaatctggaaatttcattagtaatgtgaagacctgactatagttatagttctacataacagtgttaaaaacaaaacctatgttattattaaaaattagttccttcctccctctaccagccctgattccactcacccccgatctcccttcctcttaatatttttctgcttttatgtattttatatttttaaggctaatgacaaatagttacttatctattaagttattgatgttcaacttatcttgcagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctccta

SEQ ID NO: 439838 - DNA, 2146 bp, Homo sapiens
gatgggctgaccttgacctccaagatagttctgatctactgtattttaacctttctttaactctttctcctcccaagctcttggtacagatttgtatattgaggattaaccttgtttagcctcctcacttgcccctactctcattgctgccttactgtgatagtcactggtgatcttagggactgatgtaggagataattggtatagtagaagtcagactgagaccctgagaccattgcctggaggttgattttgggggcaggagagggttaacattttttttgtatttttattttttggaaggctttgctaacacttgtcacctataaagctatgatgtttatatttaggtttaaacatttcacattttaaggaaagactgaaatgaggataggattcagttaaagtaagatttatgtgttgctacttacagctactaatttctttcttcttaaaaatcattaattatgtttttgaaatctcagaaatgtttttcaattactgacttatcaaatttgcattttattaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctccta

SEQ ID NO: 439839 - DNA, 1197 bp, Homo sapiens
  misc_feature (7)..(7): n is a, c, g, or t
ctcgtcnaattcggcagagaacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctccta

SEQ ID NO: 439840 - DNA, 1822 bp, Homo sapiens
gggccctacagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaaggtataatttttatttttaaaaaaaatttgttttattactgttacatttactccagtttactatcataggcacatacttgctaaaggaaaccaaagtctagtttcactgtggttacagctctccttgtgtcagtgggtgtggacataagagtctcaaagatattttagttagctgtttacagcccccatgtgaggctgtctgggggactgggagaagatttataaatagcccaatgtcttcagctgttggattttctttttttttttttctttagcttaaatcttttatgaaggggtggagagattgctttgcttgaaatgggcccttctgcatatcttaacaccatttttgggcattccaccgaaattcttggggaaatttagtagccttcattttagcaatattagtcattttaatagctgttctatactttaagagaaatcataaagagaaattcagattgtaacccaatattccttctcttatataaaaaatatgtataaaattttagtagtgatgcctttctaatttagaggaacacttgttagtacataataggctttttgagagaaaataaatgctatttaagaaattctgt

SEQ ID NO: 439841 - DNA, 1946 bp, Homo sapiens
gggccctacagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatggtatgattattcatcttactatttttttttttactgtgaaatggtatttctttactgcctagcctcagtacacactattttgcaaaaaatagtcattgctttcagagactatgctatttgataagtaacaagttactttttttggatattaagatttgaaaataatttcagtgatttcatttttttattgtaatatggggaagaagatgaactttgggaaaggagaaatttggaagaaagaagataaggaaaggaaaattgaagtgttaaaaggatgtagttcttggcaaatatggacactggttagagaaaagaggataaaaatactatttgttttattagaacaatattcttagtgcatcagaagcatacctgaactcccaattttgcttttcctgccttttagacactaaaatagactgcttctaaattagtgtgattgtgttctaaaagaccacttgctaatttagtttcagattctgaaagcatttttttccacagaaacaaagttatacatggttgttgttacgtaagccaacaagcctatgtacctaatgcatgtttatagtaaaaagtaatactatagaaacaattcattttattttgttttgaaatttttatttaaaactttattatttaaatgt

SEQ ID NO: 439842 - DNA, 546 bp, Homo sapiens
caacaaagaacatgttagtataaatagctttaaaagtggtataatttgcttactatttagaaaaacacttctacccaataaatgaagaagaaagaaaaatccctgctttacagtttttagtcttatctagatccaattattagtttttaagttaatgtatttttggtgacttatcttttattaattaaaaacatttgcagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacaggtaagcttattcatgttttgggtattatttttattatgtcattatttagttgcctggatttacaacttactgttttcaatgatactgtatgctaaatcaatattacttggacattatcttgaatttcaaattattttccatactt

SEQ ID NO: 439843 - DNA, 3516 bp, Homo sapiens
gggccctacagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctcctaaaaaaaaaaaaaaaaaaaaaaaaaaaaaaaaaaaaaacaaacaaaaaaaaaaaaaaaaaaaacaaaaaaaaaaaaaagggggggcggccaagagaacaaccaaccagggggagacaccacatgaggagaacgacgaaggcatgatggaacaaaagaggggcccaaaagatgaggagagactagacagaccaagcgccgacggacggtacaaacgaacgcagacaggaggaaaccagcatgattacacatcgagaggagaaaccacactacagggggggagaataagaagagaaagagaagaaggaaaagagcccgagacaaaaaagaaggaggtaaggggacaaccagaacagatgcggagaagagacaggagtgatgagaataa

SEQ ID NO: 439844 - DNA, 3158 bp, Homo sapiens
gggccctacagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgaacggctcatatatggcaataaaaaagtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctccta

SEQ ID NO: 439845 - DNA, 2525 bp, Homo sapiens
gggccctacagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtggtaatgatgttatgcaacttgctgtgcctcagatggactggggcacacctcactcttttgctaacaattcacataatgcatgcagggaattccttctgttttttagttcctgtctcagcagctgacctagacagggtactgtattagctagtgtctcattaatacctgatcagggcagaaaactgatagaatgggtattcctttcaattgaaaataatggtcagttcctcagcttttcatgaaatgatatgggagcagctcatatcataatgtctgaaatatttatttattcatctgtctaattcacccttttcttttaaaagccccagtttcagaatgtgaatcagggatattcctgttactaaaatggaaatgtaattccaagtttcttttttaattttttaaatttatgtcattgtattggactatgcttatatttaaaactacttaatttagagttaactacctgcttaggccccagaacattacttatgcccttcagttaccaaaagatttgtgcaaggttttgtaccctggtaaatgatgccaaagtttgttttctgtggtgtttgtcaaatgttctatgtataattaactgtctgtaacatgctgtttccttcctctgcagatgtagctgctttcctaaatctgtctgtctttctttaggttagctgtatgtctgtaaaagtatgttcaattaaattactccatcagacacttgtctgtcttgcaatgtagaagcagctttgtagcaccttgttttgaggtttgctgcatttgttgctgcactttgtgcattctgaacatgaatgtaacattagatattaagtcattgttataaggggttgaatttaaatcctgtaagtcaaaattgaaagggtgttattaagtgtgcctttattttgcatgaaaataaaaagaattatacgtaaagcattcctgtaatctggctcattgaatattttatacttaaaaaactttttttggcgtaaatatttgtgtaaatactgggttaactttttaaaagcccattacagatt

SEQ ID NO: 439846 - DNA, 1240 bp, Homo sapiens
gggccctacagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataattgataatcaacaaaaagcaacaacttagcagtttatttgccaaacaaagaaataaggtacttctttagaaacaaaacacaaaaaaggggggcgctaaagtattctggagggccaagtacccgtccagcttttggcaaggggcccaaggggcgatataagagagcggggggtaacacgcgggggacgtgctgggctggagccctcgcgcgggctatggcacccaccggttagccgaaacatagggtaggacacgcctcgggatgcggtaaccatctagtctaaaagatacacgatagaacccctactacacatcg

SEQ ID NO: 439847 - DNA, 1205 bp, Homo sapiens
  misc_feature (19)..(19): n is a, c, g, or t
  misc_feature (59)..(59): n is a, c, g, or t
  misc_feature (66)..(66): n is a, c, g, or t
  misc_feature (1205)..(1205): n is a, c, g, or t
tccgggggtcccccccccnactcaaccacacaaaaaaaaaaaaaaaaaaaacttagganggaactnagtggttttcccgctgtatctttcagagaacaatgactgatgttgcagattgcttgaaagttttcatgactggtactaaaaatatagcaatgtgggtgggctccaaggactgttccttcagacctcaaatccacatgcttatagaagaccacataggagcactcaacaaatggtacaagtacaatcatgatttgccagcacggataattgtgtaccgtgctggtgtaggggatggtcagctgaaaacacttattgaatatgaagtcccacagctgctgagcagtgtggcagaatccagctcaaataccagctcaagactgtcggtgattgtggtcaggaagaagtgcatgccacgattctttaccgaaatgaaccgcactgtacagaaccccccacttggcactgttgtggattcagaagcaacacgtaacgaatggtatgacttttatctgatcagccaggtggcctgccggggaactgttagtcctacctactataatgtcatctatgatgacaacggcttgaagcccgaccatatgcagagacttacattcaaattgtgccacctgtactacaactggccgggcatagtcagtgtcccagcaccatgtcagtatgctcacaagctgacctttctggtggcacaaagcattcataaagaacccagtctggaattagccaaccatctcttctacctgtgatggcatgaactactggcatcactagatggacaatccaagaagaaattggtatactttgtgcaaatctgccataagctcaaggctgtgactggggaaaaagattgagcttagttttcatgtctaggaaaaaaagcaaaacaacttaatctgaaacagttttaaaaaatgtgtgttattttgttttaaagagttgtatgcttggggtaaattttcattgtcatatgtggaatttaaatataccatcatctacaaagaattccacagagttaaatatcttaagttaaacacttaaaataagtgtttgcgtgatattttgatgatagataaacagagtctaattcccaccccaaattttgctgaggttttcttaatgttgtagagcattttgtagagtggtttaaatagttgaaaataaagttcagaacatcaaaaaaaaan

SEQ ID NO: 439848 - DNA, 1109 bp, Homo sapiens
  misc_feature (1109)..(1109): n is a, c, g, or t
tcacaataatttataatactgtatcataattttaaagacacaaaaaaacaacacagtggttttcccgctgtatctttcagagaacaatgactgatgttgcagattgcttgaaagttttcatgactggagcactcaacaaatggtacaagtacaatcatgatttgccagcacggataattgtgtaccgtgctggtgtaggggatggtcagctgaaaacacttattgaatatgaagtcccacagctgctgagcagtgtggcagaatccagctcaaataccagctcaagactgtcggtgattgtggtcaggaagaagtgcatgccacgattctttaccgaaatgaaccgcactgtacagaaccccccacttggcactgttgtggattcagaagcaacacgtaacgaatggtatgacttttatctgatcagccaggtggcctgccggggaactgttagtcctacctactataatgtcatctatgatgacaacggcttgaagcccgaccatatgcagagacttacattcaaattgtgccacctgtactacaactggccgggcatagtcagtgtcccagcaccatgtcagtatgctcacaagctgacctttctggtggcacaaagcattcataaagaacccagtctggaattagccaaccatctcttctacctgtgatggcatgaactactggcatcactagatggacaatccaagaagaaattggtatactttgtgcaaatctgccataagctcaaggctgtgactggggaaaaagattgagcttagttttcatgtctaggaaaaaaagcaaaacaacttaatctgaaacagttttaaaaaatgtgtgttattttgttttaaagagttgtatgcttggggtaaattttcattgtcatatgtggaatttaaatataccatcatctacaaagaattccacagagttaaatatcttaagttaaacacttaaaataagtgtttgcgtgatattttgatgatagataaacagagtctaattcccaccccaaattttgctgaggttttcttaatgttgtagagcattttgtagagtggtttaaatagttgaaaataaagttcagaacatcaaaaaaaaan

SEQ ID NO: 439849 - DNA, 296 bp, Homo sapiens
cgaaatgaaccgcactgtacagaaccccccacttggcactgttgtggattcagaagcaacacgtaacgaatggcaagtgccgctggaaaatcaatttttaacaaaacattcattgcgtccagtttatgtttgaccttattctgtttgccttctttcctacattcattccattttccccctcaggtatgacttttatctgatcagccaggtggcctgccggggaactgttagtcctacctactataatgtcatctatgatgacaacggcttgaagcccgaccatatgcagagactta

SEQ ID NO: 439850 - DNA, 1105 bp, Homo sapiens
  misc_feature (38)..(39): n is a, c, g, or t
  misc_feature (42)..(42): n is a, c, g, or t
  misc_feature (1105)..(1105): n is a, c, g, or t
ccacttgtactcagttattttcaatcaacacaaaaacnnaantaactttgagtggttttcccgctgtatctttcagagaacaatgactgatgttgcagattgcttgaaagttttcatgactggagcactcaacaaatggtacaagtacaatcatgatttgccagcacggataattgtgtaccgtgctggtgtaggggatggtcagctgaaaacacttattgaatatgaagtcccacagctgctgagcagtgtggcagaatccagctcaaataccagctcaagactgtcggtgattgtggtcaggaagaagtgcatgccacgattctttaccgaaatgaaccgcactgtacagaaccccccacttggcactgttgtggattcagaagcaacacgtaacgaatggtatgacttttatctgatcagccaggtggcctgccggggaactgttagtcctacctactataatgtcatctatgatgacaacggcttgaagcccgaccatatgcagagacttacattcaaattgtgccacctgtactacaactggccgggcatagtcagtgtcccagcaccatgtcagtatgctcacaagctgacctttctggtggcacaaagcattcataaagaacccagtctggaattagccaaccatctcttctacctgtgatggcatgaactactggcatcactagatggacaatccaagaagaaattggtatactttgtgcaaatctgccataagctcaaggctgtgactggggaaaaagattgagcttagttttcatgtctaggaaaaaaagcaaaacaacttaatctgaaacagttttaaaaaatgtgtgttattttgttttaaagagttgtatgcttggggtaaattttcattgtcatatgtggaatttaaatataccatcatctacaaagaattccacagagttaaatatcttaagttaaacacttaaaataagtgtttgcgtgatattttgatgatagataaacagagtctaattcccaccccaaattttgctgaggttttcttaatgttgtagagcattttgtagagtggtttaaatagttgaaaataaagttcagaacatcaaaaaaaaan

SEQ ID NO: 439851 - DNA, 1104 bp, Homo sapiens
  misc_feature (55)..(55): n is a, c, g, or t
  misc_feature (70)..(70): n is a, c, g, or t
  misc_feature (1104)..(1104): n is a, c, g, or t
ctaatatacaacatgatatcgtcgtacagtcaaagaacacaaagccaaagcttangtggaactccgctgntctttcagagacacgactgatgttgcagattgcttgaaagtttttttactggagcactcaacaaatggtacaagtacaatcatgatttgccagcacggataattgtgtaccgtgctggtgtaggggatggtcagctgaaaacacttattgaatatgaagtcccacagctgctgagcagtgtggcagaatccagctcaaataccagctcaagactgtcggtgattgtggtcaggaagaagtgcatgccacgattctttaccgaaatgaaccgcactgtacagaaccccccacttggcactgttgtggattcagaagcaacacgtaacgaatggtatgacttttatctgatcagccaggtggcctgccggggaactgttagtcctacctactataatgtcatctatgatgacaacggcttgaagcccgaccatatgcagagacttacattcaaattgtgccacctgtactacaactggccgggcatagtcagtgtcccagcaccatgtcagtatgctcacaagctgacctttctggtggcacaaagcattcataaagaacccagtctggaattagccaaccatctcttctacctgtgatggcatgaactactggcatcactagatggacaatccaagaagaaattggtatactttgtgcaaatctgccataagctcaaggctgtgactggggaaaaagattgagcttagttttcatgtctaggaaaaaaagcaaaacaacttaatctgaaacagttttaaaaaatgtgtgttattttgttttaaagagttgtatgcttggggtaaattttcattgtcatatgtggaatttaaatataccatcatctacaaagaattccacagagttaaatatcttaagttaaacacttaaaataagtgtttgcgtgatattttgatgatagataaacagagtctaattcccaccccaaattttgctgaggttttcttaatgttgtagagcattttgtagagtggtttaaatagttgaaaataaagttcagaacatcaaaaaaaaan

SEQ ID NO: 439852 - DNA, 1194 bp, Homo sapiens
  misc_feature (50)..(50): n is a, c, g, or t
  misc_feature (1194)..(1194): n is a, c, g, or t
ttatagcagataatctctacgaataaaaccacaaaacaacaagcttgagnggaaacgtggttttcccgctgtatctttcagagaacaatgactgatgttgcagattgcttgaaagttttcatgactggtactaaaaatatagcaatgtgggtgggctccaaggactgttccttcagacctcaaatccacatgcttatagaagaccacataggagcactcaacaaatggtacaagtacaatcatgatttgccagcacggataattgtgtaccgtgctggtgtaggggatggtcagctgaaaacacttattgaatatgaagtcccacagctgctgagcagtgtggcagaatccagctcaaataccagctcaagactgtcggtgattgtggtcaggaagaagtgcatgccacgattctttaccgaaatgaaccgcactgtacagaaccccccacttggcactgttgtggattcagaagcaacacgtaacgaatggtatgacttttatctgatcagccaggtggcctgccggggaactgttagtcctacctactataatgtcatctatgatgacaacggcttgaagcccgaccatatgcagagacttacattcaaattgtgccacctgtactacaactggccgggcatagtcagtgtcccagcaccatgtcagtatgctcacaagctgacctttctggtggcacaaagcattcataaagaacccagtctggaattagccaaccatctcttctacctgtgatggcatgaactactggcatcactagatggacaatccaagaagaaattggtatactttgtgcaaatctgccataagctcaaggctgtgactggggaaaaagattgagcttagttttcatgtctaggaaaaaaagcaaaacaacttaatctgaaacagttttaaaaaatgtgtgttattttgttttaaagagttgtatgcttggggtaaattttcattgtcatatgtggaatttaaatataccatcatctacaaagaattccacagagttaaatatcttaagttaaacacttaaaataagtgtttgcgtgatattttgatgatagataaacagagtctaattcccaccccaaattttgctgaggttttcttaatgttgtagagcattttgtagagtggtttaaatagttgaaaataaagttcagaacatcaaaaaaaaan

SEQ ID NO: 439853 - DNA, 319 bp, Homo sapiens
cattttaaagtatatgtaggaacttaagggttcaccctagttggatagtgaaaacagaaaacagggaatcaattttaagttgttcaactttgcttattgtgagtaaagatatatataatctagcaaagttatgcaaagttagaatatacccattgccctatattctcgatgatagttacccctgccaccattccccacaccctcttagtaagcccatgcagacatcattaatcaagtaggtaggtcattctccgctaatcctagctgaaaaatcaaagtcttaaaattagccacaacatcagagatgacacaggagtta

SEQ ID NO: 439854 - DNA, 560 bp, Homo sapiens
tgtttgttttgagacagggtctcactctgtcacccagactgaagtgcaatggtgcaattatagctcattgcagcctcaaactccaggactcaggtggttctcctacctcagcctcccgagtagctaggactataggcatgtgccaccacaccaggctggtaacttctattagatatcctcttggagctattgagttttaagttgtatgaatgcattgcattacatttcaaatttaaaatacaattttaaaaataagaatgttaactagataattatgtaacaacttaaaaactttgcttaccagaattttattaaaatgttatttggctttcgatcatttaaaaaattcttcatttcttaaagatttatctaatttctctaccaagcatacacagtaataatagcaacaagaaaattaccatcagggagacataaaagcagtataatgaagctagtatagcaagaaggggtgcaaataagaaacgaatactcagaggatctcagctttttatttataaaaattgcaagattttgaacatgcatattagattttattaatt

SEQ ID NO: 439855 - DNA, 1225 bp, Homo sapiens
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgcccttggcctgaagcccacagcattgatggcagcgcctcatcttcaacttttgtgctcccctttgcctaaaccctatggcctcctgtgcatctgtactcaccctgtaccacaaacacattacattattaaatgtttctcaaagatgga

SEQ ID NO: 439856 - DNA, 720 bp, Homo sapiens
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagtttcccggggcctgggtggaacgggacgccttggggggccgggcccttgaattggcccggaagttaaccttgggggaaaacacagggccccaggcaccacgtggaaccaattccccttggcgcaacacgggaacgaaaggccgggtgtcccccgtcctcgcgattgtggggaaacccaagccccgttaaactttggggtgccaggggaaacccaaacccaaaaaagccttttaaaacgcaggagaggggactattctaggacgtggcgggcaatgcgacagggcccttttttcgcaacaccccagagaggtagtgcgtcgggaccccaagagaggcccgagagggcaccgcgcgcacaaggtctttctcgcccgccaagattttctcc

SEQ ID NO: 439857 - DNA, 710 bp, Homo sapiens
  misc_feature (10)..(10): n is a, c, g, or t
  misc_feature (13)..(15): n is a, c, g, or t
  misc_feature (25)..(25): n is a, c, g, or t
  misc_feature (27)..(29): n is a, c, g, or t
  misc_feature (32)..(32): n is a, c, g, or t
  misc_feature (710)..(710): n is a, c, g, or t
tctatagganacnnncggtgggtcntnnncanctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439858 - DNA, 692 bp, Homo sapiens
  misc_feature (10)..(10): n is a, c, g, or t
  misc_feature (13)..(15): n is a, c, g, or t
  misc_feature (25)..(25): n is a, c, g, or t
  misc_feature (27)..(29): n is a, c, g, or t
  misc_feature (32)..(32): n is a, c, g, or t
  misc_feature (480)..(480): n is a, c, g, or t
  misc_feature (482)..(482): n is a, c, g, or t
  misc_feature (519)..(519): n is a, c, g, or t
tctatagganacnnncggtgggtcntnnncanctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagaaaaaaaaaaaaaaaaaaaaaaaaaaaaaaaaaaaaaaaaaaaaaaaaaaaaaaaaaaaaaaaaaaaaaaaaaaaaaaaananaaaaaaaaaaaaaccttgcggcccccttggcccaagngatttttaaactggggcaggttttagcatgggcccgaatttggggttaattgggcaaattcgccctatggggggccatttaaaatcaatggcccgggtttaacaacgtcggaactggaaaaccctgggtgtccccaattaaatgccttggatccccttttcccagttggcgcg

SEQ ID NO: 439859 - DNA, 348 bp, Homo sapiens
  misc_feature (269)..(269): n is a, c, g, or t
  misc_feature (303)..(303): n is a, c, g, or t
aaggatacacaagtgcaccgtagtttgatactctccgctgcactggtgaacgcatctcaccaaccccgtacttgtgtctgcagtacgtgtccaccccggcacagcctccgcgccaggaggtccttcttgcctgctgctctggcccctggtcctgtcctgttctccagcatggtgtgtctgaggctccctggaggctcctgcatggcagttctgacagtgacactgatggtgctgagctccccactggctttggctggggacaccagacnacgtttcttggaggaggttaagtttgagtgtatntcttcaacgggtagaacggggatactctagagtacctcagcataa

SEQ ID NO: 439860 - DNA, 2601 bp, Homo sapiens
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgcccttggcctgaagcccacagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaaagggaaggaagattatttcccaatagaataatgattttcatgtatatgtcatgagtatgtgaggtaatgcatatgtaaaataacttgatttagacattccacactataggcatatatcaaaacttcattctgtacaatataaatacactatacaatttttacttgtcaatcaaaaaagtaatcctaatgtttaaaaaggcaatgcataaaaaactgagaacagactataacaactgaaacaaacttgggcaaccatgagatgagaaaccagctagcaagtcaatcagaactttttttcaccccgtctacaatattttgtatttataactgtaaattagtgtatagtgtttcactccagagacttcaataatatagtgttatcaaaggacttgtacagatttcagagaaagacaaatttagaagacggaggattctctattatgtgctatctgagagtcagtatgaaatgtcaaatccaaaagtacataatttagaggtctatttcaaagtaatcatttgagcatagtttctccactgtcagagacgactgttattttattttcaatcaaattaaaacttgtttttatgcatatcttatttttagttatatgttacttgtacataagtagcagcacaatacgtacatataaaccctatgagtataaatcctatagaaatatattaagttgataattatgtctgttctgtttgatcacagagttgcaacaaagaggcctcatttcctaagttgaggaaatgattttctcattttatatgagactcgtggtgtggaattacaaggtagaaccaaaatgtgtggaatgagtatttcagtgaagatgtgttctgctgctaataacaggaaattacatctagtggctttatttttctttaacccattatctcacatagccgatagatccaaggctgggcatctccagggttgctcaactcagcaggccagtggcatcaccagcgaccctggaacttcatagctcatctctctatcacacacagtatgtcagctttcctgagatggtagggtgacccctgcagcagctttaggtttgttattcattcacaacaactcccaaaggcaggaaaaggatactcctttctcctgtgtgcctttataaggagcaactaaactgtttccagagtgttcccagtacccactttctcacacattggaatgaccgtgggatcacacgggctcagacaagccaggattcaacctttgcagagtgggcctgaggcacatgggaagaaaaggagcaaaatcatgtattttaaaaaataaagaaatggtggatggagta

SEQ ID NO: 439861 - DNA, 1517 bp, Homo sapiens
  misc_feature (1305)..(1305): n is a, c, g, or t
  misc_feature (1307)..(1307): n is a, c, g, or t
  misc_feature (1344)..(1344): n is a, c, g, or t
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgcccttggcctgaagcccacagcattgatggcagcgcctcatcttcaacttttgtgctcccctttgcctaaaccctatggcctcctgtgcatctgtactcaccctgtaccacaaacacattacattattaaatgtttctcaaagatggaaaaaaaaaaaaaaaaaaaaaaaaaaaaaaaaaaaaaaaaaaaaaaaaaaaaaaaaaaaaaaaaaaaaaaaaaaaaaaaananaaaaaaaaaaaaaccttgcggcccccttggcccaagngatttttaaactggggcaggttttagcatgggcccgaatttggggttaattgggcaaattcgccctatggggggccatttaaaatcaatggcccgggtttaacaacgtcggaactggaaaaccctgggtgtccccaattaaatgccttggatccccttttcccagttggcgcg

SEQ ID NO: 439862 - DNA, 2601 bp, Homo sapiens
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaagaacactctcctctgtcttttgcaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgcccttggcctgaagcccacagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaaagggaaggaagattatttcccaatagaataatgattttcatgtatatgtcatgagtatgtgaggtaatgcatatgtaaaataacttgatttagacattccacactataggcatatatcaaaacttcattctgtacaatataaatacactatacaatttttacttgtcaatcaaaaaagtaatcctaatgtttaaaaaggcaatgcataaaaaactgagaacagactataacaactgaaacaaacttgggcaaccatgagatgagaaaccagctagcaagtcaatcagaactttttttcaccccgtctacaatattttgtatttataactgtaaattagtgtatagtgtttcactccagagacttcaataatatagtgttatcaaaggacttgtacagatttcagagaaagacaaatttagaagacggaggattctctattatgtgctatctgagagtcagtatgaaatgtcaaatccaaaagtacataatttagaggtctatttcaaagtaatcatttgagcatagtttctccactgtcagagacgactgttattttattttcaatcaaattaaaacttgtttttatgcatatcttatttttagttatatgttacttgtacataagtagcagcacaatacgtacatataaaccctatgagtataaatcctatagaaatatattaagttgataattatgtctgttctgtttgatcacagagttgcaacaaagaggcctcatttcctaagttgaggaaatgattttctcattttatatgagactcgtggtgtggaattacaaggtagaaccaaaatgtgtggaatgagtatttcagtgaagatgtgttctgctgctaataacaggaaattacatctagtggctttatttttctttaacccattatctcacatagccgatagatccaaggctgggcatctccagggttgctcaactcagcaggccagtggcatcaccagcgaccctggaacttcatagctcatctctctatcacacacagtatgtcagctttcctgagatggtagggtgacccctgcagcagctttaggtttgttattcattcacaacaactcccaaaggcaggaaaaggatactcctttctcctgtgtgcctttataaggagcaactaaactgtttccagagtgttcccagtacccactttctcacacattggaatgaccgtgggatcacacgggctcagacaagccaggattcaacctttgcagagtgggcctgaggcacatgggaagaaaaggagcaaaatcatgtattttaaaaaataaagaaatggtggatggagta

SEQ ID NO: 439863 - DNA, 1529 bp, Homo sapiens
  misc_feature (1529)..(1529): n is a, c, g, or t
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439864 - DNA, 1473 bp, Homo sapiens
  misc_feature (1473)..(1473): n is a, c, g, or t
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacaatttaaggaagaatcttcttccccagctttgcaggatgaaaagctttcccgcctggctgttattcttccacgagagagggctttctcaggacctagttgctactggttcagctcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439865 - DNA, 1255 bp, Homo sapiens
gacccacgcgtccgcggacgcgtgggtcgacccacgcgtgcggacccacgcgtcccttgcctgctgctctggcccctggtcctgtcctgttctccagcatggtgtgtctgaggctccctggaggctcctgcatggcagttctgacagtgacactgatggtgctgagctccccactggctttggctggggacaccagacgaggccgcctgtgtgactggatcgttcgtgtccccacagcacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgcccttggcctgaagcccacagcattgatggcagcgcctcatcttcaacttttgtgctcccctttgcctaaaccctatggcctcctgtgcatctgtactcaccctgtaccacaaacacattacattattaaatgtttctcaaagatgga

SEQ ID NO: 439866 - DNA, 2490 bp, Homo sapiens
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgcccttggcctgaagcccacagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaaagggaaggaagattatttcccaatagaataatgattttcatgtatatgtcatgagtatgtgaggtaatgcatatgtaaaataacttgatttagacattccacactataggcatatatcaaaacttcattctgtacaatataaatacactatacaatttttacttgtcaatcaaaaaagtaatcctaatgtttaaaaaggcaatgcataaaaaactgagaacagactataacaactgaaacaaacttgggcaaccatgagatgagaaaccagctagcaagtcaatcagaactttttttcaccccgtctacaatattttgtatttataactgtaaattagtgtatagtgtttcactccagagacttcaataatatagtgttatcaaaggacttgtacagatttcagagaaagacaaatttagaagacggaggattctctattatgtgctatctgagagtcagtatgaaatgtcaaatccaaaagtacataatttagaggtctatttcaaagtaatcatttgagcatagtttctccactgtcagagacgactgttattttattttcaatcaaattaaaacttgtttttatgcatatcttatttttagttatatgttacttgtacataagtagcagcacaatacgtacatataaaccctatgagtataaatcctatagaaatatattaagttgataattatgtctgttctgtttgatcacagagttgcaacaaagaggcctcatttcctaagttgaggaaatgattttctcattttatatgagactcgtggtgtggaattacaaggtagaaccaaaatgtgtggaatgagtatttcagtgaagatgtgttctgctgctaataacaggaaattacatctagtggctttatttttctttaacccattatctcacatagccgatagatccaaggctgggcatctccagggttgctcaactcagcaggccagtggcatcaccagcgaccctggaacttcatagctcatctctctatcacacacagtatgtcagctttcctgagatggtagggtgacccctgcagcagctttaggtttgttattcattcacaacaactcccaaaggcaggaaaaggatactcctttctcctgtgtgcctttataaggagcaactaaactgtttccagagtgttcccagtacccactttctcacacattggaatgaccgtgggatcacacgggctcagacaagccaggattcaacctttgcagagtgggcctgaggcacatgggaagaaaaggagcaaaatcatgtattttaaaaaataaagaaatggtggatggagta

SEQ ID NO: 439867 - DNA, 1247 bp, Homo sapiens
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggccagaaggacatcctggaagacaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgcccttggcctgaagcccacagcattgatggcagcgcctcatcttcaacttttgtgctcccctttgcctaaaccctatggcctcctgtgcatctgtactcaccctgtaccacaaacacattacattattaaatgtttctcaaagatgga

SEQ ID NO: 439868 - DNA, 1333 bp, Homo sapiens
  misc_feature (1333)..(1333): n is a, c, g, or t
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439869 - DNA, 913 bp, Homo sapiens
aattgtgtcatccttgttcatacagagagtcgggttgaaggagtgggatacgggtgagagtgggcgctgtggagctggaaaggcaaaggacttctggaagggagaggggcgaggtgacactattgagacacatacgggttgtggagagttcacagtgcagcgggagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgcccttggcctgaagcccacagcattgatggcagcgcctcatcttcaacttttgtgctcccctttgcctaaaccctatggcctcctgtgcatctgtactcaccctgtaccacaaacacattacattattaaatgtttctcaaagatgga

SEQ ID NO: 439870 - DNA, 1131 bp, Homo sapiens
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgcccttggcctgaagcccacagcattgatggcagcgcctcatcttcaacttttgtgctcccctttgcctaaaccctatggcctcctgtgcatctgtactcaccctgtaccacaaacacattacattattaaatgtttctcaaagatgga

SEQ ID NO: 439871 - DNA, 609 bp, Homo sapiens
cacgaggtttaactccatctttgagaaacatttaataatgtaatgtgtttgtggtacagggtgagtacagatgcacaggaggccataggtacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgcccttggcctgaagcccacagcattgatggcagcgcctcatcttcaacttttgtgctcccctttgcctaaaccctatggcctcctgtgcatctgtactcaccctgtaccacaaacacattacattattaaatgtttctcaaagatgga

SEQ ID NO: 439872 - DNA, 1559 bp, Homo sapiens
  misc_feature (1559)..(1559): n is a, c, g, or t
gacccacgcgtccgcggacgcgtgggtcgacccacgcgtgcggacccacgcgtcccttgcctgctgctctggcccctggtcctgtcctgttctccagcatggtgtgtctgaggctccctggaggctcctgcatggcagttctgacagtgacactgatggtgctgagctccccactggctttggctggggacaccagacgaggccgcctgtgtgactggatcgttcgtgtccccacagcacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439873 - DNA, 1217 bp, Homo sapiens
  misc_feature (1217)..(1217): n is a, c, g, or t
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacctgccaagtggagcacccaagcgtaacgagccctctcacagtggaatggagtgagcagctttctgatttcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439874 - DNA, 1386 bp, Homo sapiens
  misc_feature (1386)..(1386): n is a, c, g, or t
agcatggtgtgtctgaagctccctggaggctccagcttggcagcgttgacagtgacactgatggtgctgagctcccgactggctttcgctggggacacccgaccacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccaggtggacaattactgcagacacaactacggggttgtgtgagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccagaatggagactggaccttccagaccctggtgatgctagaaacagttcctcggagtggagaggtttacacctgccaagtggagcacccaagcgtaacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439875 - DNA, 417 bp, Homo sapiens
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcaacttttgtgctcccctttgcctaaaccctatggcctcctgtgcatctgtactcaccctgtaccacaaacacattacattattaaatgtttctcaaagatgga

SEQ ID NO: 439876 - DNA, 1143 bp, Homo sapiens
  misc_feature (1143)..(1143): n is a, c, g, or t
agcatggtgtgtctgaagctccctggaggctccagcttggcagcgttgacagtgacactgatggtgctgagctcccgactggctttcgctggggacacccgaccacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccaggtggacaattactgcagacacaactacggggttgtgtgagagcttcacagtgcagcggcgaggagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439877 - DNA, 678 bp, Homo sapiens
  misc_feature (678)..(678): n is a, c, g, or t
cgggtcgcctaaaactactaaattcgcggccgcgtcgactgaccgattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439878 - DNA, 915 bp, Homo sapiens
  misc_feature (915)..(915): n is a, c, g, or t
ccaatcaagggaagaaggaggaatgctgtgactggaaggcccctggatgcagaatggcaagaagggtgacagcttcctttccctgtgtgtactctgtccaagtcctgtagataaaatggatgcccagaggacttccaacccttgctttgggtcaagaaacagccagcaagattttatgggccttagggcacttgggctgttgttccattgaagccgactcctggccctggcccttacttgcttctctagctctctaggcctctcccatttgcacctgtccccaccctccactcagctgtcctgcagcaaacactccaccccttcaccgtccattttgacccggtacattcaagttgctgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439879 - DNA, 387 bp, Homo sapiens
gataaataggtgccaagtggagcacccaagtgtgatgagccccctcacagtggaatggagtgtgaagctttatgacctcataaattgaaggttatcttcaggcattgttttatatattttacatgcattaatcctcatataatcccaagaggtaaattagtataattatccttcattataggtgacaaagttgagacacagaagaatcaaactcttaaggcagaccttggatttgaaccaggcaacctggctcagatatcagttttaattactacactctgtactttcaaagatttgtaaacactttgacaatgcatgacaatttcaagctatgaagaaacaaacacaatttttcacaatatctctcaaatctaataggtcctcact

SEQ ID NO: 439880 - DNA, 400 bp, Homo sapiens
ttctcatgtacccaactctgtccctttgtctatgtacattgctttaaatcatatttttctgtcacggtgtacaaggatgataaataggtgccaagtggagcacccaagtgtgatgagcccccttacggtggaatggagtgagaagctttctgatctcataaattgaaggctatcttcagtcattatgtattttacataaattaatcctcatataaccccaagaggtaaattagtataattatccttcattgggggtgacaaagttgagacacagaagaatcaactcttccaggatcaaccagtaaaaggcagaccttggatttgaaccatgcaacctggctcaggtatcagttttaattactacactctgtactttcaaaaatttgtaaacactttgaca

SEQ ID NO: 439881 - DNA, 921 bp, Homo sapiens
ggagtcgggggctttgtgctgggcctgctcttccttggggccgggctgttcatctacttcaggaatcagaaaggtgaggagcctttggtagctggctctctccataggcttttctggaggaggaactatggctttgctgaggttagttctcagtatatgagtggccctgaataaagcctttctttccccaaacggctctaatgtcctgctaatccagaaatcatcagtgcatggttactatgtgaaagcataatagcttgtggcctgcagagacaagaggaaggttaacaagtaggggtcctttggtttgagatcttggagcagattaaggaagagccactaagactaatggaattacactggatcctgtgacagacactttacccttcatgggtcacatggtctgtttctgctcctctctgccctggctggtgtgggttgtagtgacagagaactctccggtgggagatctggggctgggacattgtgttggaagacagatttgcttccataaattttaagtgtatatattttcctctttttcccaggacactctggacttcagccaagaggtaataccttttaatcctcttttagaaacagatacggtttccctagtgagaggtgaagccagctggacttctgggtcgggtagggacttgcagaactttcctgtcttaggagaggtttctaaatgcaccaatcagtgctctgtaaaaacacaccaattggcactctgtggctagatagatgtttgtaaaatggactaatcagcactctgtaaaatggagcaatccacactctgtaaaatggaccaatcaatgctctttaaaatggaccaatcagcaggacatgggcggggacaaataagggaatacaagctggccaccccagccagcagcagcaacccgctcaggtcgc

SEQ ID NO: 439882 - DNA, 437 bp, Homo sapiens
  misc_feature (386)..(387): n is a, c, g, or t
tgtttatcgatgccacctcgaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggaagcgnntgaatctgcacagagcaagatgctgagggcatcgaaacaccggacggcga

SEQ ID NO: 439883 - DNA, 1216 bp, Homo sapiens
gacccacgcgtccgcggacgcgtgggtcgacccacgcgtgcggacccacgcgtcccttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgcccttggcctgaagcccacagcattgatggcagcgcctcatcttcaacttttgtgctcccctttgcctaaaccctatggcctcctgtgcatctgtactcaccctgtaccacaaacacattacattattaaatgtttctcaaagatgga

SEQ ID NO: 439884 - DNA, 1505 bp, Homo sapiens
  misc_feature (1505)..(1505): n is a, c, g, or t
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439885 - DNA, 1394 bp, Homo sapiens
  misc_feature (1394)..(1394): n is a, c, g, or t
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439886 - DNA, 1060 bp, Homo sapiens
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagtgagcagctttctgacttcataaatttctcacccaccaagaaggggactgtgctcatccctgagtgtcaggtttctcctctccgacatcctattttcatttgctccatgttctcatctccatcagcacaggtcactgggggtagccctgtaggtgtttctagaaacacctgtacctcctggagaagcagtctcgcctgccaggcaggagaggctgtccctcttttgaacctccccatgatgtcacaggtcagggtcacccaccctccccgggctccaggcactgcctctgggtctgaga

SEQ ID NO: 439887 - DNA, 1164 bp, Homo sapiens
  misc_feature (1164)..(1164): n is a, c, g, or t
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctgaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439888 - DNA, 1529 bp, Homo sapiens
  misc_feature (1529)..(1529): n is a, c, g, or t
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacctgccaagtggagcacccaagcgtaacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439889 - DNA, 1694 bp, Homo sapiens
  misc_feature (1694)..(1694): n is a, c, g, or t
agcatggtgtgtctgaagctccctggaggctccagcttggcagcgttgacagtgacactgatggtgctgagctcccgactggctttcgctggggacacccgaccacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccaggtggacaattactgcagacacaactacggggttgtgtgagagcttcacagtgcagcggcgaggatgataaataggtgccaagtggagcacccaagtgtgatgagcccccttacggtggaatggagtgagaagctttctgatctcataaattgaaggctatcttcagtcattatgtattttacataaattaatcctcatataaccccaagaggtaaattagtataattatccttcattgggggtgacaaagttgagacacagaagaatcaactcttccaggatcaaccagtaaaaggcagaccttggatttgaaccatgcaacctggctcagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacctgccaagtggagcacccaagcgtaacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439890 - DNA, 782 bp, Homo sapiens
  misc_feature (782)..(782): n is a, c, g, or t
gtgctctgcaggactattggctctgggagactcaggaacttgtttttcttcttcctgcagtgttctcatctgagtccttcaaagagggggaaagaaacgttagtagagccaggttgaaaacaacactctcctctgtcttttgcaggatgattcctgagctgaagtgcagatgacaatttaaggaagaatcttcttccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagttaaatatcatctggtccatttggctccaaagacaaaaaatgaaaagaaaagaaaagaaaaagggaagattatttcctaacaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439891 - DNA, 543 bp, Homo sapiens
tgggtgctgtttaaggaaccggtaaacatgtgggatgagagaaggagcagagtgtctttggggtggaggctcccaggaggaggcggcgcgggctgcggtgctgggcggatcctcctccagctcctgcttggaggtctccagaacaggctggaggtagggaggggggtcccaaaagcctggggatcagacgtggttttcccgcctggtcccccaggccccctttcgcctcaggaagacagaggaggagcccctgggctgctggtggtgggcgttgcggcgggggccggttaaggttcccagtgcccgcaccccacccagggagccccggatggcggcgtcactgtcagtgtcttctcaggaggccgcctgtgtgactggatcgttcgtgtccccacagcacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctg

SEQ ID NO: 439892 - DNA, 1448 bp, Homo sapiens
  misc_feature (1448)..(1448): n is a, c, g, or t
cagtaacttactccctataacttggaatgtgggtggaggggttcatagttctccctgagtgagacttgcctgctgctctggcccctggtcctgtcctgttctccagcatggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacctcctggaagcagagcggggccgcggtggacacctactgcagacacaactacggggttgtggagagcttcacagtgcagcggcgagtccatcctaaggtgactgtgtatccttcaaagacccagcccctgcagcaccacaacctcctggtctgttctgtgagtggtttctatccaggcagcattgaagtcaggtggttccggaatggccaggaagagaagactggggtggtgtccacaggcctgatccacaatggagactggaccttccagaccctggtgatgctggaaacagttcctcggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaagaggattcctgagctgaagtgcagatgacacattcaaagaagaactttctgccccagctttgcaggatgaaaagctttccctcctggctgttattcttccacaagagagggctttctcaggacctggttgctactggttcagcaactgcagaaaatgtcctcccttgtggcttcctcagctcctgcccttggcctgaagcccacagcattgatggcagcgcctcatcttcaacttttgtgctcccctttgcctaaaccctatggcctcctgtgcatctgtactcaccctgtaccacaaacacattacattattaaatgtttctcaaagatggaaaaaaaaaataaaacaactaaaacttaaaatatttaaaattaaactaccatataattttataaccattccaattctttcttccgggtttaatctgggcaacttttacattccccccattataggcctattgggcgatttcccctaaggggggcgaattaacatctatgggccctgttttacaccttggccctgggaaatcctggcgtgtcccaactttaagcn

SEQ ID NO: 439893 - DNA, 3170 bp, Homo sapiens
ggcctgctgctggccgggcgggggacggggccgggaccggagccggagctgcggggcgcaccggctagacgcgcgcgggattctcggcgggcacgccccgcggaccatgagcgtccccagctccgggagcagccgcggcgcgggcggtgcgaggccggccgcgcggcgcctttgagccccagccggaggtccagagatcctgagagcccgagcgcccagcgccgcgccgggagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtga

SEQ ID NO: 439894 - DNA, 996 bp, Homo sapiens
ggcctgctgctggccgggcgggggacggggccgggaccggagccggagctgcggggcgcaccggctagacgcgcgcgggattctcggcgggcacgccccgcggaccatgagcgtccccagctccgggagcagccgcggcgcgggcggtgcgaggccggccgcgcggcgcctttgagccccagccggaggtccagagatcctgagagcccgagcgcccagcgccgcgccgggaggtgagtctccgccgcgcgcccagcgtcctcggggtgctgttcctcccggggcgcctgggcctcccccaccccggtgaggacacgctaggaagtttgttggacaaagttaggctctggggaaagtagagccggcgtttgttggtccctacccacccccgccagcggatttggcgttgggggcgggggtgactgaagtggggctggggcttgcgctctccaggccctccgagcgcgctgggactccccgagacgtggcccacggcggggagcgctcagcgattggcggccaggcatcttgctcggtggcactcgagcggcatcttcccgggcgctggcctcgcccgaccccctgcccgtcggagctgctctgccggccaccccgccctgtcccgcccgtcccctcttcgcagaagccggccggggtcgggcagatgcgagggcccagagcgctctggtggaagcccaaggctccgaggaggcgagtttctccggtaatctcttgggaagtttgcaaagaaagcgaaggagcctgccctgtaactgttgacaacatctccctccctctctccctttgttgagaaagaatgaatagttggttgtgttgctccctctgcgtcgcggtggggagaggcgagggaaggcaaaggaagggagggacggtgggaaggaggttccgatagatcgtacagcccaactgtccttacccacttaggccgctgagggcgccgccgctttaaaacggtgtaatcaggtgtagacactc

SEQ ID NO: 439895 - DNA, 440 bp, Homo sapiens
gagcatcccccaaacgcagagaggagaatctaagcgattctaagagccccaactccgcctagagctgggcaatcctcagcccgtcttggagaaaagaaagcagcgaggcaatgcctggatccgagaggaacgcttctctttttgtgtctcaagtcgcctgcatcctgtcatttagctccggcttcctctctgcgtttgaaacgcagagaggatcctgtcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtttggcagagaggacaaacccagagaggacaaacgcagagaggttctcgtgttgaccaaggaatactcctgcttgctgat

SEQ ID NO: 439896 - DNA, 2826 bp, Homo sapiens
gagggaaggtacctcaggtactcgggaggaggttggaccaagacccactggctgggagaggccgtcttggctggagtgatggcgggcctcagacagaagaggaaaatgaggctcctcaggctggagtgcagtggcgccatctcagctcgccgcaacctctgcctcccagattcaagtgattctcctgcctcaccctcccaagtagctgggattacagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtga

SEQ ID NO: 439897 - DNA, 4274 bp, Homo sapiens
ttttgacgggctcccgctgggattcgggtgtctgctcatctggaagcctccatgctggagaggtagtcagcacagcgcacgcagggcgtaggcgtgttttctcgtccctccctcgcaaccacagtcccgctcaaggcgtgggggtgtcacccgagacccgggcctcccctgcactttcctttaggccgaaaccgcgagccttcgcttcagtgtcgcttttccttcgccgccgccgccgccgccgccgccgctcttctcaggacctacatcgactgcccagtcggctgagctgggccctgggccaccgaggcccggggagctgaggggctcgggaccctgcgagccgcttaagaagaaggaccgcaagtaccgaatgcagtgaactgcgagagcacgggaatgagagagaaattaaaccgtttagccaaatattaaaaaataagagacatgatggaggcagaaaataaattgtaggggggagggaaaaaagcgttacgactccgccgggactcgaacccggaacctttgaatgccttcagcctctagaagtccaatgcgctatccattgcgccacggagccacctgttggagtctcagcgcatctgctatgttaagccagaggcgacggccccgcgctcttccgaccgcgcctcccgtcgtcagtgtcaccgagacccagccgccgcgctcagggcactgccatccgcctcaaacgccagccgcaggctctcggtctccccgcagtggtcgcccctcaacaaggtcggcgacccagttgagccaagggcggccgcagtccgacggtcccacctggtcggtgtgagggcagccgcaacccggtccccttcacggtccgggcccagccgtacgaatcacagtcgcgcttttccctccccggctcccttcctgccccaagcgccccgcctaccaggtctctccggcggccgctccagcccggcctggaccccagagttgcacgcccaggccagccgttgcaccgttaagccgggccggtgacgccgggcctttacgtcgcgcctgtgagcggccgaggccgagcggcctcccctcgggctgcgagacggagacattacctcatccctcaagattgctcgctgcaaacacaacgctgagaaatggcccaagtaaagcgtgatcagggtcttgcattcttggcacatctaggaagaacgtgcaaggatgcgaattgtgaatcgcttctccaaacagagctgcttcatctgacccaagctggcctggagaaaggaggaagaggcaagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtgaaacagttgtatccagtctctttcatattaaacaactcatcttggtacaataactcta

SEQ ID NO: 439898 - DNA, 1293 bp, Homo sapiens
ggatcccccggcaggctgtactccaccggcaggttgtactccaccggcaggttgtactccaccggcaggttgtactccaccggcaggttgtactcatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtga

SEQ ID NO: 439899 - DNA, 4218 bp, Homo sapiens
  misc_feature (3806)..(3806): n is a, c, g, or t
  misc_feature (3825)..(3825): n is a, c, g, or t
  misc_feature (3827)..(3827): n is a, c, g, or t
  misc_feature (3829)..(3830): n is a, c, g, or t
  misc_feature (3834)..(3834): n is a, c, g, or t
  misc_feature (3838)..(3838): n is a, c, g, or t
  misc_feature (3842)..(3844): n is a, c, g, or t
  misc_feature (3847)..(3847): n is a, c, g, or t
  misc_feature (3849)..(3849): n is a, c, g, or t
ttttgacgggctcccgctgggattcgggtgtctgctcatctggaagcctccatgctggagaggtagtcagcacagcgcacgcagggcgtaggcgtgttttctcgtccctccctcgcaaccacagtcccgctcaaggcgtgggggtgtcacccgagacccgggcctcccctgcactttcctttaggccgaaaccgcgagccttcgcttcagtgtcgcttttccttcgccgccgccgccgccgccgccgccgctcttctcaggacctacatcgactgcccagtcggctgagctgggccctgggccaccgaggcccggggagctgaggggctcgggaccctgcgagccgcttaagaagaaggaccgcaagtaccgaatgcagtgaactgcgagagcacgggaatgagagagaaattaaaccgtttagccaaatattaaaaaataagagacatgatggaggcagaaaataaattgtaggggggagggaaaaaagcgttacgactccgccgggactcgaacccggaacctttgaatgccttcagcctctagaagtccaatgcgctatccattgcgccacggagccacctgttggagtctcagcgcatctgctatgttaagccagaggcgacggccccgcgctcttccgaccgcgcctcccgtcgtcagtgtcaccgagacccagccgccgcgctcagggcactgccatccgcctcaaacgccagccgcaggctctcggtctccccgcagtggtcgcccctcaacaaggtcggcgacccagttgagccaagggcggccgcagtccgacggtcccacctggtcggtgtgagggcagccgcaacccggtccccttcacggtccgggcccagccgtacgaatcacagtcgcgcttttccctccccggctcccttcctgccccaagcgccccgcctaccaggtctctccggcggccgctccagcccggcctggaccccagagttgcacgcccaggccagccgttgcaccgttaagccgggccggtgacgccgggcctttacgtcgcgcctgtgagcggccgaggccgagcggcctcccctcgggctgcgagacggagacattacctcatccctcaagattgctcgctgcaaacacaacgctgagaaatggcccaagtaaagcgtgatcagggtcttgcattcttggcacatctaggaagaacgtgcaaggatgcgaattgtgaatcgcttctccaaacagagctgcttcatctgacccaagctggcctggagaaaggaggaagaggcaagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagacgccccgctcccccccccgcgccccccccgcctcccctcccccntcccccccgcccccccccngngnncgcncccngccnnngcncncgtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtga

SEQ ID NO: 439900 - DNA, 3302 bp, Homo sapiens
ttttgacgggctcccgctgggattcgggtgtctgctcatctggaagcctccatgctggagaggtagtcagcacagcgcacgcagggcgtaggcgtgttttctcgtccctccctcgcaaccacagtcccgctcaaggcgtgggggtgtcacccgagacccgggcctcccctgcactttcctttaggccgaaaccgcgagccttcgcttcagtgtcgcttttccttcgccgccgccgccgccgccgccgccgctcttctcaggacctacatcgactgcccagtcggctgagctgggccctgggccaccgaggcccggggagctgaggggctcgggaccctgcgagccgcttaagaagaaggaccgcaagtaccgaatgcagtgaactgcgagagcacgggaatgagagagaaattaaaccgtttagccaaatattaaaaaataagagacatgatggaggcagaaaataaattgtaggggggagggaaaaaagcgttacgactccgccgggactcgaacccggaacctttgaatgccttcagcctctagaagtccaatgcgctatccattgcgccacggagccacctgttggagtctcagcgcatctgctatgttaagccagaggcgacggccccgcgctcttccgaccgcgcctcccgtcgtcagtgtcaccgagacccagccgccgcgctcagggcactgccatccgcctcaaacgccagccgcaggctctcggtctccccgcagtggtcgcccctcaacaaggtcggcgacccagttgagccaagggcggccgcagtccgacggtcccacctggtcggtgtgagggcagccgcaacccggtccccttcacggtccgggcccagccgtacgaatcacagtcgcgcttttccctccccggctcccttcctgccccaagcgccccgcctaccaggtctctccggcggccgctccagcccggcctggaccccagagttgcacgcccaggccagccgttgcaccgttaagccgggccggtgacgccgggcctttacgtcgcgcctgtgagcggccgaggccgagcggcctcccctcgggctgcgagacggagacattacctcatccctcaagattgctcgctgcaaacacaacgctgagaaatggcccaagtaaagcgtgatcagggtcttgcattcttggcacatctaggaagaacgtgcaaggatgcgaattgtgaatcgcttctccaaacagagctgcttcatctgacccaagctggcctggagaaaggaggaagaggcaagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtga

SEQ ID NO: 439901 - DNA, 1890 bp, Homo sapiens
ttttgacgggctcccgctgggattcgggtgtctgctcatctggaagcctccatgctggagaggtagtcagcacagcgcacgcagggcgtaggcgtgttttctcgtccctccctcgcaaccacagtcccgctcaaggcgtgggggtgtcacccgagacccgggcctcccctgcactttcctttaggccgaaaccgcgagccttcgcttcagtgtcgcttttccttcgccgccgccgccgccgccgccgccgctcttctcaggacctacatcgactgcccagtcggctgagctgggccctgggccaccgaggcccggggagctgaggggctcgggaccctgcgagccgcttaagaagaaggaccgcaagtaccgaatgcagtgaactgcgagagcacgggaatgagagagaaattaaaccgtttagccaaatattaaaaaataagagacatgatggaggcagaaaataaattgtaggggggagggaaaaaagcgttacgactccgccgggactcgaacccggaacctttgaatgccttcagcctctagaagtccaatgcgctatccattgcgccacggagccacctgttggagtctcagcgcatctgctatgttaagccagaggcgacggccccgcgctcttccgaccgcgcctcccgtcgtcagtgtcaccgagacccagccgccgcgctcagggcactgccatccgcctcaaacgccagccgcaggctctcggtctccccgcagtggtcgcccctcaacaaggtcggcgacccagttgagccaagggcggccgcagtccgacggtcccacctggtcggtgtgagggcagccgcaacccggtccccttcacggtccgggcccagccgtacgaatcacagtcgcgcttttccctccccggctcccttcctgccccaagcgccccgcctaccaggtctctccggcggccgctccagcccggcctggaccccagagttgcacgcccaggccagccgttgcaccgttaagccgggccggtgacgccgggcctttacgtcgcgcctgtgagcggccgaggccgagcggcctcccctcgggctgcgagacggagacattacctcatccctcaagattgctcgctgcaaacacaacgctgagaaatggcccaagtaaagcgtgatcagggtcttgcattcttggcacatctaggaagaacgtgcaaggatgcgaattgtgaatcgcttctccaaacagagctgcttcatctgacccaagctggcctggagaaaggaggaagaggcaagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtacctggtcttgtcccttccagagcatacacggctgctctcaggcaatgtacagattgatgacccgcagggtcccactccgaggccacatgggcggaagcacctgtgtaacc

SEQ ID NO: 439902 - DNA, 475 bp, Homo sapiens
tgagatggagtctcgcttgtcacccaggctgcagtgcagtggcgcagtctcgctcactgcaagctccacctcccgggttcacgccattctcctgcctcagcctcccgagtagctgggactacaggcgctcgccaccacgcctggctaattttttgtatttttttagtagagacgggatttcactgtgttagccaggatggtctcgatctcctgatcttgtgatccacccacctcggcctcccaaagtgctgggattacaggcgtgagccaccgcgcctggtgctttcagtctatttttaacacatcttaggcagaactgaagtaactttttgtttattttgtttcattaggttttcaaccagatgaagaaatgaatgaaatctgcaagactgaatttcaaatgcgattgctatggggcagcaaaggtgcacaagtcaatcagacagagagatatgagaaattcaaccagatttta

SEQ ID NO: 439903 - DNA, 329 bp, Homo sapiens
catcctaggactcagctgctgcattggtcatggggacagggggatggagtacacaacacagtcatatattaatcgtcccatcagtaatttgtttctccagcggtcattcctttacttttagggtatgctgtagcactctcgttctgagcagttttctttttttttgtttttgtttaagttcccatggcattgcctaaaagttttattttacacgttagtaacacatttccatcctatgtgtcttttacttcagaaacaaagaaaagagtggtagccagcccgcctgcctggatcacatgcaggacagaagagccttgtccctcaaagcc

SEQ ID NO: 439904 - DNA, 4217 bp, Homo sapiens
ttttgacgggctcccgctgggattcgggtgtctgctcatctggaagcctccatgctggagaggtagtcagcacagcgcacgcagggcgtaggcgtgttttctcgtccctccctcgcaaccacagtcccgctcaaggcgtgggggtgtcacccgagacccgggcctcccctgcactttcctttaggccgaaaccgcgagccttcgcttcagtgtcgcttttccttcgccgccgccgccgccgccgccgccgctcttctcaggacctacatcgactgcccagtcggctgagctgggccctgggccaccgaggcccggggagctgaggggctcgggaccctgcgagccgcttaagaagaaggaccgcaagtaccgaatgcagtgaactgcgagagcacgggaatgagagagaaattaaaccgtttagccaaatattaaaaaataagagacatgatggaggcagaaaataaattgtaggggggagggaaaaaagcgttacgactccgccgggactcgaacccggaacctttgaatgccttcagcctctagaagtccaatgcgctatccattgcgccacggagccacctgttggagtctcagcgcatctgctatgttaagccagaggcgacggccccgcgctcttccgaccgcgcctcccgtcgtcagtgtcaccgagacccagccgccgcgctcagggcactgccatccgcctcaaacgccagccgcaggctctcggtctccccgcagtggtcgcccctcaacaaggtcggcgacccagttgagccaagggcggccgcagtccgacggtcccacctggtcggtgtgagggcagccgcaacccggtccccttcacggtccgggcccagccgtacgaatcacagtcgcgcttttccctccccggctcccttcctgccccaagcgccccgcctaccaggtctctccggcggccgctccagcccggcctggaccccagagttgcacgcccaggccagccgttgcaccgttaagccgggccggtgacgccgggcctttacgtcgcgcctgtgagcggccgaggccgagcggcctcccctcgggctgcgagacggagacattacctcatccctcaagattgctcgctgcaaacacaacgctgagaaatggcccaagtaaagcgtgatcagggtcttgcattcttggcacatctaggaagaacgtgcaaggatgcgaattgtgaatcgcttctccaaacagagctgcttcatctgacccaagctggcctggagaaaggaggaagaggcaagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtga

SEQ ID NO: 439905 - DNA, 2569 bp, Homo sapiens
tgatataagtgagccacaaggagattatgtaatttgtccagagtcatacagctgagccaggatgcaaacccaggtggtcaggctacaggaacagccaggctgcaccacattataaattctccagttgctgtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtga

SEQ ID NO: 439906 - DNA, 4045 bp, Homo sapiens
ttttgacgggctcccgctgggattcgggtgtctgctcatctggaagcctccatgctggagaggtagtcagcacagcgcacgcagggcgtaggcgtgttttctcgtccctccctcgcaaccacagtcccgctcaaggcgtgggggtgtcacccgagacccgggcctcccctgcactttcctttaggccgaaaccgcgagccttcgcttcagtgtcgcttttccttcgccgccgccgccgccgccgccgccgctcttctcaggacctacatcgactgcccagtcggctgagctgggccctgggccaccgaggcccggggagctgaggggctcgggaccctgcgagccgcttaagaagaaggaccgcaagtaccgaatgcagtgaactgcgagagcacgggaatgagagagaaattaaaccgtttagccaaatattaaaaaataagagacatgatggaggcagaaaataaattgtaggggggagggaaaaaagcgttacgactccgccgggactcgaacccggaacctttgaatgccttcagcctctagaagtccaatgcgctatccattgcgccacggagccacctgttggagtctcagcgcatctgctatgttaagccagaggcgacggccccgcgctcttccgaccgcgcctcccgtcgtcagtgtcaccgagacccagccgccgcgctcagggcactgccatccgcctcaaacgccagccgcaggctctcggtctccccgcagtggtcgcccctcaacaaggtcggcgacccagttgagccaagggcggccgcagtccgacggtcccacctggtcggtgtgagggcagccgcaacccggtccccttcacggtccgggcccagccgtacgaatcacagtcgcgcttttccctccccggctcccttcctgccccaagcgccccgcctaccaggtctctccggcggccgctccagcccggcctggaccccagagttgcacgcccaggccagccgttgcaccgttaagccgggccggtgacgccgggcctttacgtcgcgcctgtgagcggccgaggccgagcggcctcccctcgggctgcgagacggagacattacctcatccctcaagattgctcgctgcaaacacaacgctgagaaatggcccaagtaaagcgtgatcagggtcttgcattcttggcacatctaggaagaacgtgcaaggatgcgaattgtgaatcgcttctccaaacagagctgcttcatctgacccaagctggcctggagaaaggaggaagaggcaagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtga

SEQ ID NO: 439907 - DNA, 1188 bp, Homo sapiens
aatgatacgatcgagtcggacctctgtatgctcagggacacagcgcgccggacataatgaaagaacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtga

SEQ ID NO: 439908 - DNA, 1213 bp, Homo sapiens
cacttctcgggagatatttccttttgtaatttgccctcggtcttgtcttatcttcgaaaggttgctggaatttctctgttccttggagtttgggggttttttgatttgttttttctttggtgcttgtaaagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtga

SEQ ID NO: 439909 - DNA, 394 bp, Homo sapiens
ggtacagggtactaggagccacatgcacttctgagcacctttgccccaggagctccctctttgtgcccccaggtccagggttgaatgtggccctgtccggggacatcttgctttctgactgaaagtgcaccctctgtggcctactttggccctccacagtcagcctgctaaggggcgttctctctgttgagattggccgtctaaactgtgctgccggcacattttagagcaaaaggagcaaatggcacaaaaacagccctgctcttggctgatttggtttagttttctcctagtcccattggccctgaacctgaccgctgatctcctggctttcagacacaacacaatggccatcggcattgcagtggacattctgggatgcacgggcactttg

SEQ ID NO: 439910 - DNA, 1430 bp, Homo sapiens
gcacgaggttgtatatatcaattagcctctgataaattggttttattatatgttatttcccctaacgtcgcagtttccaagaacctatcaagtacattaaatgacaacttactgtacactgattaaaatgctattgtaataatttggggggaaagcaataaaggtagtggaaataggtataggtagtggaagtaggtatatatataatctcagcattttgggacaccaaggcggaggatcagttgagctcaggagttcgagaccaacctggacaacataatgagaccacatctttatagaaacaaagtagctgggtgtggtggtgcttgcctgtggtctcagttacttgggagcctgaggttggaggattgcttgaacccaagaggttaaagccgtagtgagctatgatcatgccactgcactccactctaggcaacagagcaagactagcaaaaaaaaaaaaaaaaaaaaaaaaaaagaaagaaaggatgtcttggaactgttgcaacttggtaactactgaatgtgagggctgagcaacaagcctgacaactacagggtttcaagcctacttgattggcagcctggggttccctcagtataagcagggagcccaagagaagtgagatcaggaggaaaatttgtttggttttggtataacgtttgcaggtgtgatggttatatacaggtgatgatgattctgataaaaagaaaattagtattctctttagaaaggatgtgcatctgttgctttcgtgccttcattttgatatagctaactcccagaaagagaagtaagactcagttgctggatctattgctggcatcagaatctagataattgatttggaaaactttgacacagtacctgaatttttcttttcatctgtaagtagctcaacccttttcactaagtttgttagataagttgctctggttgtaaaaacactatgtattctcagtagcttgatacaacttacaggttatcctttgaaatctcctttactgctgcttcattggttatggatatctaagtagtgcctttcttacgtctttgaagaaaacagatgagcagttgagtgttcccaactagtaaccttgatcaccttgagatgaaggcagtgtttatttgaattaaaaggtttgcatgcttttgccataccatactcctgtttttccccttaggacatagagccacattggaagaggacaagccttttaacctaattagtggtagttaagatgttagttgccaaaacatttctttaacagcctacatttaacaaaataccagaagatatcagaggatgtagctttctatgccaggcagattcaagaacaacagtgtaaggttcttttagatttatagcattttcagagccctgtagcaggaggtgtttttaacccaaagatgatagacaaaaaaatta

SEQ ID NO: 439911 - DNA, 108 bp, Homo sapiens
agatgaacagctgaccgtgttttcaaagataccacctggggaaacagccagaagctggaagtcatcccaagagagaagtcagccaggggttggagaccccagcagaag

SEQ ID NO: 439912 - DNA, 2999 bp, Homo sapiens
agcaaaccaatcgcaagcctcgttgagtggaaggggtgggatcttccccggaagtgttggttaaagcccctccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaatcatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttgcctctcttgtttaaaaggaa

SEQ ID NO: 439913 - DNA, 429 bp, Homo sapiens
ggacgcgtgggtcgacccacgcgtcgaataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttgcctctcttgtttaaaaggaa

SEQ ID NO: 439914 - DNA, 648 bp, Homo sapiens
  misc_feature (1)..(1): n is a, c, g, or t
nctcttctttcccttgtcactttttgtgtgttccctcctgtgaggttgatatcttcgtttcggcgggggtgtgtttctccttctgttttggtcccccccccccgcaggtgtggtggggtgtctcttcccccggaggatcttcctcgctctcgtccgctgttttttctcctgccatctagcgtcgggtgttgtttattgctaggcgtggccgggcgctcgttctgcgtctgtctctattaataagaggcctcctcttttgttgggcccccttcttgtttcagcaacaagccggccggctgcggcggtttgggggccccccggggggggtttttggggcggcccccccccttttttttttttttttttttttttttttttttttttttttttttttttttttttttttttttttttttttttttcacagtacattttttattctgtgttgaaaatgtacaaaatatccccacttcccttgagaaagagtatatctaaaatacacttctatagcatataatgttttaatattctgtgttcatcaaagtgtattttagatatactctttctcaagggaagtggggatattttgtacattttcaacacagaataaaaaatgtactgtgccttgcctctcttgtttaaaaggaa

SEQ ID NO: 439915 - DNA, 306 bp, Homo sapiens
agcaaaccaatcgcaagcctcgttgagtggaaggggtgggatcttccccggaagtgttggttaaagcccctccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcaggtaggtgggtgctggagagctggacggagaacactggcccgcttccgttgaaggtctagaagggtctgaggaccgggggctgcgagcggg

SEQ ID NO: 439916 - DNA, 3058 bp, Homo sapiens
tctgtggtaagcccagagcctcttttattctggactatcacttactggctttctcttcactggtcaagcaagttcctatttaaaacccccaaataggtagcttcttattctctgataatcttcttctcacttttcagtgttacatatttatttcattgcacattttatatttttatttcagaaggccctgaagtgggacaggaaatgaactgtaatcttaattttttaaataatgaaaattcatgtaagttgggttttgtccttttccttgacaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaatcatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttgcctctcttgtttaaaaggaa

SEQ ID NO: 439917 - DNA, 2150 bp, Homo sapiens
gtcgcaacgatcacccaaagatctttgagcatcaccgtgatgcataatgagccaggcagagagctgaaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaatcatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttgcctctcttgtttaaaaggaa

SEQ ID NO: 439918 - DNA, 3090 bp, Homo sapiens
agcaaaccaatcgcaagcctcgttgagtggaaggggtgggatcttccccggaagtgttggttaaagcccctccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaatcatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcagtgggatcttgctatgttgctcgggctggtcttgaagtcctgggttcaagtgatcctaccacctcagcctcccgagtagctgggactacagccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttgcctctcttgtttaaaaggaa

SEQ ID NO: 439919 - DNA, 3210 bp, Homo sapiens
agcaaaccaatcgcaagcctcgttgagtggaaggggtgggatcttccccggaagtgttggttaaagcccctccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaatcatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcagtgggatcttgctatgttgctcgggctggtcttgaagtcctgggttcaagtgatcctaccacctcagcctcccgagtagctgggactacaggtgtgcaccaccgcacccggtttatttttgttattaattaatccactatagaatgttgaagaattaattggtgaaactcttgatggatactttactgacttctctggatttgttctccagccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttgcctctcttgtttaaaaggaa

SEQ ID NO: 439920 - DNA, 730 bp, Homo sapiens
gcttgagtccatttacatattattcacatttttgtacatatattctgaatatacctttccaataaaaaaaactgtaatatacatttgaaataagatctactggaaagtagcataatcattgttgtttataattttattgttatatagggaaaatgtttacgtgtttcttgtttgtttgtttttgaggtgggatcttgctatgttgctcgggctggtcttgaagtcctgggttcaagtgatcctaccacctcagcctcccgagtagctgggactacaggtgtgcaccaccgcacccggtttatttttgttattaattaatccactatagaatgttgaagaattaattggtgaaactcttgatggatactttactgacttctctggatttgttctccagccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgt

SEQ ID NO: 439921 - DNA, 689 bp, Homo sapiens
gaaatgtatgtcataattttagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttagggtaagtttgtgggttttatatccaatttttttttttttagttaaggaactgttatacatacatccaaatttctaatatagattcttctacttcttgtttttaagttttaaaaacatttaggtttagatttctcattattttacaaagttaagtctttatactacttagagtgtacttgattgcctttgaagaaagagcaaggaaatcgatcaacataaaatttaggatagttatgtctagagagaagaaaggaggggctgtgattgaattggggtacccagagggcttctaagttaccacatactggatatatga

SEQ ID NO: 439922 - DNA, 2986 bp, Homo sapiens
  misc_feature (2912)..(2912): n is a, c, g, or t
agcaaaccaatcgcaagcctcgttgagtggaaggggtgggatcttccccggaagtgttggttaaagcccctccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaatcatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttccatccaaaagttgttttttttaanaataatactcttttcctcaaaggggaaaattggggggaataatttttggttaccatttttttcccaacccccta

SEQ ID NO: 439923 - DNA, 203 bp, Homo sapiens
agaggattttctattcttctgaaaggcaaatgacaatatgggtagcttacctgaatcatgtggggatgtgaattccagttttactctccataagactgaatgggacaatggaaatatctgcttactattttagcctgatagcagctgttttttttttttttttttttttttggggggcactcataggcaggcggcgcggggca

SEQ ID NO: 439924 - DNA, 5681 bp, Homo sapiens
agaggattttctattcttctgaaaggcaaatgacaatatgggtagcttacctgaatcatgtggggatgtgaattccagttttactctccataagactgaatgggacaatggaaatatctgcttactattttagcctgatagcagctgtttttttttttttttttttttttttgctttgtttctcagcttcttgctctgcatataggcagcttaggaatggcaaatgccatgacaggaatatcatgtagaatattgagctcactttacagttcattttctctaacctcttgtgagttgactgccttggtagtcctgaactcaattttagtcttcatatcctactgacactgccactgttctaggcagccacagtctgtttagcccatgtacctcaccactagaattgacaaatacgctaagggaaaagagtggccatggctcaccttattatatttctgttctacctgggatcttggccctctagtcctgattgcctttgttgctcttcattgctttaaaacatctgagaggttttgcttgttttgggttctattttattcagctttcatatttgttttcagcaggagagttgagtcgtctttacagatagaagtgtaaattcccatctgctgagtttttaagtcattttttcaagtatattatgttaattgccgtatgctttacattcttcaggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccaccatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagttttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacatagattaactggtttctgcactttccatgtgtttgtgggtggaaaaaaattcagtggtttttttttaaaaaaaaaagcaaaaacaaagctacatattgcctaatactctatttcagtgtcgtttattgttcagtttatttccctgattggcacaaacacaagagtttccttgaaccatgtaccaagcaaatacaaaatatttcatgaagaaatccccaggctggcagtttgtgatgaatagttcttgttggaactatatgtattgctgataaaaaaggacgaagtattttcattgagcaaataaaatgaagggctccagaatatgtgctctgtggtcgctgcgcctgggctggcagtgtgctccacagagaggcagccgtcccaggaggttatctacccacacaccccagtcctgccctgccgtgccccccacaggctgctcagtgcctgggaagccagaaacgctgcccgtgaaatacagaacacaggatgcagaagcacgtttgtgtggcagagtctacttgaatcatccaaaacccaagatcgccctcctgcctctgacagtatagaaggcgtgactgaatgtggctgccttttgaaaaaggttccatagagacactgaggtctctgattcagaaggagatgatgtgtctacacctttcacctctgaagcttctaaagagctagtaattattttatataataagacgtcatgcattttaaataaatatgcaacaagacctcaggcttattatactaggttatcttaaacacctgaaagaagtaaatgatttgccaaatgattccgctccatatgaataataccttcaaagatacatagagattaatgttttatttaccacttctgtgcaatcgctattttaaaattgagaaaactcatccacagtaatgggtgtcattactattcagtcttgattgattttggtctcagactagaagataaaaatggtttaccagtcttggaaagaaactatagtttaatagccacaggaaaagatgcattttcaaaaatcaaaagcacagtgagatgactagagcgggacatcctaccaaatccagtgttgagcaagcgtctcctgaacagcagacgcttgtcctttctggcttagtgtttcaggttggtgtttctcgtctccagttcttgatgatgatcttgtgtttgtgccactgcgtagtggcccgaagctaggggagcgtggctggagcaggctgcacagtggagcagacaccctcctagcagaagagaa

SEQ ID NO: 439925 - DNA, 4967 bp, Homo sapiens
tgagtctgtttatttcccagataacaacttagcatgcccaggttgcgtgttcatggagcatgcctgcctaccaaaagtgttttgtttttgttttaccataggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccaccatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagttttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacatagattaactggtttctgcactttccatgtgtttgtgggtggaaaaaaattcagtggtttttttttaaaaaaaaaagcaaaaacaaagctacatattgcctaatactctatttcagtgtcgtttattgttcagtttatttccctgattggcacaaacacaagagtttccttgaaccatgtaccaagcaaatacaaaatatttcatgaagaaatccccaggctggcagtttgtgatgaatagttcttgttggaactatatgtattgctgataaaaaaggacgaagtattttcattgagcaaataaaatgaagggctccagaatatgtgctctgtggtcgctgcgcctgggctggcagtgtgctccacagagaggcagccgtcccaggaggttatctacccacacaccccagtcctgccctgccgtgccccccacaggctgctcagtgcctgggaagccagaaacgctgcccgtgaaatacagaacacaggatgcagaagcacgtttgtgtggcagagtctacttgaatcatccaaaacccaagatcgccctcctgcctctgacagtatagaaggcgtgactgaatgtggctgccttttgaaaaaggttccatagagacactgaggtctctgattcagaaggagatgatgtgtctacacctttcacctctgaagcttctaaagagctagtaattattttatataataagacgtcatgcattttaaataaatatgcaacaagacctcaggcttattatactaggttatcttaaacacctgaaagaagtaaatgatttgccaaatgattccgctccatatgaataataccttcaaagatacatagagattaatgttttatttaccacttctgtgcaatcgctattttaaaattgagaaaactcatccacagtaatgggtgtcattactattcagtcttgattgattttggtctcagactagaagataaaaatggtttaccagtcttggaaagaaactatagtttaatagccacaggaaaagatgcattttcaaaaatcaaaagcacagtgagatgactagagcgggacatcctaccaaatccagtgttgagcaagcgtctcctgaacagcagacgcttgtcctttctggcttagtgtttcaggttggtgtttctcgtctccagttcttgatgatgatcttgtgtttgtgccactgcgtagtggcccgaagctaggggagcgtggctggagcaggctgcacagtggagcagacaccctcctagcagaagagaa

SEQ ID NO: 439926 - DNA, 4284 bp, Homo sapiens
aagggaacttacgggcttggtctgtaggtgacttccgtgatccagagctgctgttctccttgataccccccctttaagcaggcagaggctctcctgattttaaatggagttctgcgtaaggaaaagagcttctacctgtgcttgcagagacatcactgccactgcaggtcttggggactgttttaatggtcccagagtatttttagcatcatatataagtcaatttatttctcaccccaactctagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccaccatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagttttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacatagattaactggtttctgcactttccatgtgtttgtgggtggaaaaaaattcagtggtttttttttaaaaaaaaaagcaaaaacaaagctacatattgcctaatactctatttcagtgtcgtttattgttcagtttatttccctgattggcacaaacacaagagtttccttgaaccatgtaccaagcaaatacaaaatatttcatgaagaaatccccaggctggcagtttgtgatgaatagttcttgttggaactatatgtattgctgataaaaaaggacgaagtattttcattgagcaaataaaatgaagggctccagaatatgtgctctgtggtcgctgcgcctgggctggcagtgtgctccacagagaggcagccgtcccaggaggttatctacccacacaccccagtcctgccctgccgtgccccccacaggctgctcagtgcctgggaagccagaaacgctgcccgtgaaatacagaacacaggatgcagaagcacgtttgtgtggcagagtctacttgaatcatccaaaacccaagatcgccctcctgcctctgacagtatagaaggcgtgactgaatgtggctgccttttgaaaaaggttccatagagacactgaggtctctgattcagaaggagatgatgtgtctacacctttcacctctgaagcttctaaagagctagtaattattttatataataagacgtcatgcattttaaataaatatgcaacaagacctcaggcttattatactaggttatcttaaacacctgaaagaagtaaatgatttgccaaatgattccgctccatatgaataataccttcaaagatacatagagattaatgttttatttaccacttctgtgcaatcgctattttaaaattgagaaaactcatccacagtaatgggtgtcattactattcagtcttgattgattttggtctcagactagaagataaaaatggtttaccagtcttggaaagaaactatagtttaatagccacaggaaaagatgcattttcaaaaatcaaaagcacagtgagatgactagagcgggacatcctaccaaatccagtgttgagcaagcgtctcctgaacagcagacgcttgtcctttctggcttagtgtttcaggttggtgtttctcgtctccagttcttgatgatgatcttgtgtttgtgccactgcgtagtggcccgaagctaggggagcgtggctggagcaggctgcacagtggagcagacaccctcctagcagaagagaa

SEQ ID NO: 439927 - DNA, 2365 bp, Homo sapiens
agaggattttctattcttctgaaaggcaaatgacaatatgggtagcttacctgaatcatgtggggatgtgaattccagttttactctccataagactgaatgggacaatggaaatatctgcttactattttagcctgatagcagctgtttttttttttttttttttttttttgctttgtttctcagcttcttgctctgcatataggcagcttaggaatggcaaatgccatgacaggaatatcatgtagaatattgagctcactttacagttcattttctctaacctcttgtgagttgactgccttggtagtcctgaactcaattttagtcttcatatcctactgacactgccactgttctaggcagccacagtctgtttagcccatgtacctcaccactagaattgacaaatacgctaagggaaaagagtggccatggctcaccttattatatttctgttctacctgggatcttggccctctagtcctgattgcctttgttgctcttcattgctttaaaacatctgagaggttttgcttgttttgggttctattttattcagctttcatatttgttttcagcaggagagttgagtcgtctttacagatagaagtgtaaattcccatctgctgagtttttaagtcattttttcaagtatattatgttaattgccgtatgctttacattcttcaggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccaccatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataaga

SEQ ID NO: 439928 - DNA, 518 bp, Homo sapiens
tcagaaagttgaataaagtttaatgatgatatgtacccaaataggattctttatagaatcactttaaatctaaaccttcatttttatgttcaaccctttggaggcagcacctctatttatggtgcttgttggacagatatcacacggcctgctgtgcagaacttcctaagaacttagtacaaaaccattcttggtagaaaactgaagaacaattctccccagaagtacttcagaagtactatagtctgtaatgcaaagcctttctcttaggagtggccatagtgctccatgagtctctgttgtaacattagatattttttctttcttagaagaaaggagcataatgtttacacatctttcagctcctgacaaattgttaacttctcttataggttgacaaagagacaaacactgatgaagccgctaatgacaatatggcagttcgccccaaagagcgcagcagcctgagctctagacagcatccgtttgtgaggagcagtgtgatagtgcgctcacag

SEQ ID NO: 439929 - DNA, 5715 bp, Homo sapiens
agcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccaccatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagttttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacatagattaactggtttctgcactttccatgtgtttgtgggtggaaaaaaattcagtggtttttttttaaaaaaaaaagcaaaaacaaagctacatattgcctaatactctatttcagtgtcgtttattgttcagtttatttccctgattggcacaaacacaagagtttccttgaaccatgtaccaagcaaatacaaaatatttcatgaagaaatccccaggctggcagtttgtgatgaatagttcttgttggaactatatgtattgctgataaaaaaggacgaagtattttcattgagcaaataaaatgaagggctccagaatatgtgctctgtggtcgctgcgcctgggctggcagtgtgctccacagagaggcagccgtcccaggaggttatctacccacacaccccagtcctgccctgccgtgccccccacaggctgctcagtgcctgggaagccagaaacgctgcccgtgaaatacagaacacaggatgcagaagcacgtttgtgtggcagagtctacttgaatcatccaaaacccaagatcgccctcctgcctctgacagtatagaaggcgtgactgaatgtggctgccttttgaaaaaggttccatagagacactgaggtctctgattcagaaggagatgatgtgtctacacctttcacctctgaagcttctaaagagctagtaattattttatataataagacgtcatgcattttaaataaatatgcaacaagacctcaggcttattatactaggttatcttaaacacctgaaagaagtaaatgatttgccaaatgattccgctccatatgaataataccttcaaagatacatagagattaatgttttatttaccacttctgtgcaatcgctattttaaaattgagaaaactcatccacagtaatgggtgtcattactattcagtcttgattgattttggtctcagactagaagataaaaatggtttaccagtcttggaaagaaactatagtttaatagccacaggaaaagatgcattttcaaaaatcaaaagcacagtgagatgactagagcgggacatcctaccaaatccagtgttgagcaagcgtctcctgaacagcagacgcttgtcctttctggcttagtgtttcaggttggtgtttctcgtctccagttcttgatgatgatcttgtgtttgtgccactgcgtagtggcccgaagctaggggagcgtggctggagcaggctgcacagtggagcagacaccctcctagcagaagagaa

SEQ ID NO: 439930 - DNA, 5613 bp, Homo sapiens
agaggattttctattcttctgaaaggcaaatgacaatatgggtagcttacctgaatcatgtggggatgtgaattccagttttactctccataagactgaatgggacaatggaaatatctgcttactattttagcctgatagcagctgtttttttttttttttttttttttttgctttgtttctcagcttcttgctctgcatataggcagcttaggaatggcaaatgccatgacaggaatatcatgtagaatattgagctcactttacagttcattttctctaacctcttgtgagttgactgccttggtagtcctgaactcaattttagtcttcatatcctactgacactgccactgttctaggcagccacagtctgtttagcccatgtacctcaccactagaattgacaaatacgctaagggaaaagagtggccatggctcaccttattatatttctgttctacctgggatcttggccctctagtcctgattgcctttgttgctcttcattgctttaaaacatctgagaggttttgcttgttttgggttctattttattcagctttcatatttgttttcagcaggagagttgagtcgtctttacagatagaagtgtaaattcccatctgctgagtttttaagtcattttttcaagtatattatgttaattgccgtatgctttacattcttcaggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccaccatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagttttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacatagattaactggtttctgcactttccatgtgtttgtgggtggaaaaaaattcagtggtttttttttaaaaaaaaaagcaaaaacaaagctacatattgcctaatactctatttcagtgtcgtttattgttcagtttatttccctgattggcacaaacacaagagtttccttgaaccatgtaccaagcaaatacaaaatatttcatgaagaaatccccaggctggcagtttgtgatgaatagttcttgttggaactatatgtattgctgataaaaaaggacgaagtattttcattgagcaaataaaatgaagggctccagaatatgtgctctgtggtcgctgcgcctgggctggcagtgtgctccacagagaggcagccgtcccaggaggttatctacccacacaccccagtcctgccctgccgtgccccccacaggctgctcagtgcctgggaagccagaaacgctgcccgtgaaatacagaacacaggatgcagaagcacgtttgtgtggcagagtctacttgaatcatccaaaacccaagatcgccctcctgcctctgacagtatagaaggcgtgactgaatgtggctgccttttgaaaaaggttccatagagacactgaggtctctgattcagaaggagatgatgtgtctacacctttcacctctgaagcttctaaagagctagtaattattttatataataagacgtcatgcattttaaataaatatgcaacaagacctcaggcttattatactaggttatcttaaacacctgaaagaagtaaatgatttgccaaatgattccgctccatatgaataataccttcaaagatacatagagattaatgttttatttaccacttctgtgcaatcgctattttaaaattgagaaaactcatccacagtaatgggtgtcattactattcagtcttgattgattttggtctcagactagaagataaaaatggtttaccagtcttggaaagaaactatagtttaatagccacaggaaaagatgcattttcaaaaatcaaaagcacagtgagatgactagagcgggacatcctaccaaatccagtgttgagcaagcgtctcctgaacagcagacgcttgtcctttctggcttagtgtttcaggttggtgtttctcgtctccagttcttgatgatgatcttgtgtttgtgccactgcgtagtggcccgaagctaggggagcgtggctggagcaggctgcacagtggagcagacaccctcctagcagaagagaa

SEQ ID NO: 439931 - DNA, 328 bp, Homo sapiens
cttaggccctggcttctagggtgcaaggaagcaccatccatcatgcgccaggaaggaggggaagtggggtaaccactgcctgtataaccagggtgttcgtcattccgtttctaactatccagacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatga

SEQ ID NO: 439932 - DNA, 3133 bp, Homo sapiens
cgcccgccccggccggagccgccatgtaaccggcgccgcccggagcccgagccgcgcgggccccagcgacccgcccgccatgggggacgaggacgacgatgagagctgcgccgtggagctgcggatcacagaagccaacctgaccgggcacgaggagaaggtgagcgtggagaacttcgagctgctcaaggtgctgggcacgggagcctacggcaaggtgttcctggtgcggaaggcgggcgggcacgacgcggggaagctgtacgccatgaaggtgctgcgcaaggcggcgctggtgcagcgcgccaagacgcaggagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcaggactcgcccttcttccagcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggca

SEQ ID NO: 439933 - DNA, 3115 bp, Homo sapiens
  misc_feature (22)..(22): n is a, c, g, or t
tagcggctgtacggccgggatntttgggatcggcgccgcccggagcccgagccgcgcgggccccagcgacccgcccgccatgggggacgaggacgacgatgagagctgcgccgtggagctgcggatcacagaagccaacctgaccgggcacgaggagaaggtgagcgtggagaacttcgagctgctcaaggtgctgggcacgggagcctacggcaaggtgttcctggtgcggaaggcgggcgggcacgacgcggggaagctgtacgccatgaaggtgctgcgcaaggcggcgctggtgcagcgcgccaagacgcaggagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcagcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggca

SEQ ID NO: 439934 - DNA, 2736 bp, Homo sapiens
attcagtggctctgccctggagaccccctctacaggcagatgactttctctggggggtctccttatcctgagcagggccaggagctggaggagctggggagggtttcggggaggaagcctcagcacccctcttgctcctaccagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcaggactcgcccttcttccagcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggca

SEQ ID NO: 439935 - DNA, 193 bp, Homo sapiens
tcaccacgcgtgggtctcaggagtgcccctagtggggagggtgagtggttctgtgggagcggaggggtcagcctcggcaccccagcctgggccggcctcaccttcccctcaccctcctagtacatgatgctgtcggggcaggtccccttccagggggcctctggccagggcgggcagagccaggcggccgaga

SEQ ID NO: 439936 - DNA, 329 bp, Homo sapiens
ctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggaggtgggcgagctgcctcggcggcggggcggagcggtggcgccgggggctgcctctgaccactaccccgccgccctcgcaaacatcctgtacgccgacgacacgcccggggccccggtgaaaatcatcgacttcgggttcgcgcggttgcggccgca

SEQ ID NO: 439937 - DNA, 3115 bp, Homo sapiens
cgcccgccccggccggagccgccatgtaaccggcgccgcccggagcccgagccgcgcgggccccagcgacccgcccgccatgggggacgaggacgacgatgagagctgcgccgtggagctgcggatcacagaagccaacctgaccgggcacgaggagaaggtgagcgtggagaacttcgagctgctcaaggtgctgggcacgggagcctacggcaaggtgttcctggtgcggaaggcgggcgggcacgacgcggggaagctgtacgccatgaaggtgctgcgcaaggcggcgctggtgcagcgcgccaagacgcaggagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcagcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggca

SEQ ID NO: 439938 - DNA, 2959 bp, Homo sapiens
cgcccgccccggccggagccgccatgtaaccggcgccgcccggagcccgagccgcgcgggccccagcgacccgcccgccatgggggacgaggacgacgatgagagctgcgccgtggagctgcggatcacagaagccaacctgaccgggcacgaggagaaggtgagcgtggagaacttcgagctgctcaaggtgctgggcacgggagcctacggcaaggtgttcctggtgcggaaggcgggcgggcacgacgcggggaagctgtacgccatgaaggtgctgcgcaaggcggcgctggtgcagcgcgccaagacgcaggagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcaggactcgcccttcttccagcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggca

SEQ ID NO: 439939 - DNA, 2730 bp, Homo sapiens
  misc_feature (309)..(309): n is a, c, g, or t
  misc_feature (385)..(385): n is a, c, g, or t
gcaaaagatcccggattttccttaaatagaagagaaacatgctatccttctgagacttgaatgagaatgtagctatgctgggtttagggaagcagggtaaggtgataatgcagaaagttgtagttcatggcgagacaaaaagccatgtcatttgggaaaaaggttaagagcacctccaaacgatggtctgtatcacttcacaagaagtctttctcaaggcccccttctgataaagactgagatagcaggcaatcgccttgtccctgctcattggaatggaagatctgcagactgaacaaagctcaagtngttgtcactgtggaaagaaccaagggcatcttcttaagggtcaggacaggatgagaggcctgtacagcccatctgnctttcttctctccaggattctttctgattcagactgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcaggactcgcccttcttccagcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggca

SEQ ID NO: 439940 - DNA, 4772 bp, Homo sapiens
ggcacgaggaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgtttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaaacttttcccgaaaggagtcttcaccaaagagctcccatctggcaagaaatacctccgctacacaccccagccttaagtctcttggagaagttggtgctgtgagccagaggatgtcagctgccaattgtgttttcctgcagcaattccataaacacatcctggtgtcatcacagccaaggtttttaggttgctataccaatggcttattaaatgaaaatggcaaaaaaaaaaaaaaaaaaaaaaaaaaaaaaaaaaaaaaaacttggtgaaaaagagcccttgaagctggaagacgggaggtgcggggaatactgttgagttatttgaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaacgtgagacccctctccccacctctagatgctggattatcccatggtcctcagatttcttttaacatactctataagcccttttcttgttataaactcttgatctcaaag

SEQ ID NO: 439941 - DNA, 1395 bp, Homo sapiens
ggcacgagggccgacccctgagttaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggtactgttcttctctacaattttggaggcagaggttggtggggggggaacttaagaagcagtaatgaggatggttttatagctattccatagccttcctctttcttatcctcgtatgtgttctcactgtttttggtcaaattttactttgccctttttgttgttcctctgcaggtcattgttgaaaataaattatctgaattataatacgaatctgcatg

SEQ ID NO: 439942 - DNA, 607 bp, Homo sapiens
caagctatccggttcaatagatccactcacttagatcattacctaatttttaatctttatccacaacacattataaatgatgatagcttaagaattataatagttttatggatttttttgtgctctagtgatcataccgtgattgattttattctaacctcctcccagggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggttggtgataaaatataagggttgtttcctgagactgggacatggtagggaattgaaccagagacaaattgaacataagaagaaagtgcttgacatgtgaactggagtaagaggaggccagggacttctacaaagaacgtgatgagtgatgtacctgtctagctagaccagagagggacacaagtgtttcacaaataagagaatgaaaagggatgaaattttggacatggtgatatttcagagaacagacatgattatagagtccagtg

SEQ ID NO: 439943 - DNA, 517 bp, Homo sapiens
gtttttttaaaagtagggaggtattggttaaattaagggagaactcctaactctcaagttgagaagaaagaaaaacaggaagaaagtagtggactggattgtcttccctggagtgcatcgtgttgtgatccagagaagtagaagctatgataaaataatttctgtggatcatgttaaatatcataacccccagatctttctgctgtcactcttcttttataggtttctcattttctttgatgatggctatgcttcctatgtcacacagtcggaactgtatcccatttgccggccacgtgagtgttttctcccttattccttagctcagttttctcctctaccttgtatttcttcttaggacatccagttgaaaagccctagtgtttttggtatttcagtctcaaagagcataagtttggttgatgtcttttgctcccaaaggtcagtttggctcccaaaagagatacagttttattgttcatctccaggactgggtctttgtagacaaagagtgaga

SEQ ID NO: 439944 - DNA, 350 bp, Homo sapiens
agtgctacctccacaaacagagagaaaatgttcaagggaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatccctgtttgtggaggtagcactctgtttgtggagtagcaatgaatcc

SEQ ID NO: 439945 - DNA, 4507 bp, Homo sapiens
cgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaagattgtggttttgtttctctctctcagcccgatactcccaattctggatctttcagtgaggtattatccccatcctcccctgtgggc

SEQ ID NO: 439946 - DNA, 4565 bp, Homo sapiens
cgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaaaaaaaaagaaaaaaaccggcacattgtcgggaatactcgggaaaccgagaagaaccccacacaataaaatgggggtgccattccacaagcaggaagggattaaaacgacgaggtcctgcaaaacagcggttcaaaaaaaaggggggaatacgggagacgcactgtaggcataaattaacgcgaccgagg

SEQ ID NO: 439947 - DNA, 5254 bp, Homo sapiens
cgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgtaagtcacctcaagcttattcagagtctaataaaggaaaatggccattgtcacctcatcaagtccttcactataattactgttaggtcttctcctacttcttctagccttgactgcgctgccttattttctttcatccagcatctaatcttcctcttgccaccgccctttcctgccaaaccgtgggtaacagcaaggacttaaaggagcccttcccatttacttctcttacttcttaccctcctgcttccccaggatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtagcctggaaaaattttgggaatggtgggaagaaatagtaagaaacttgggatagagcattttttaaggaagctaaagaagtagtgggtaaaaattcagatcctaagaattggagcatctctgggagggctttctgactccaagctaaactattgtttgacacatcctctctcatttccatttttttactctttcccctcagctcctttgtctagcagatctaattatgcttgaaaaaaaaacctgctacttaggatctttgagttccagcttattggtgtttctcagctgcaatgttgggagagaaataggggtagaatgtccattcatgatagaatgtctgttcatgagttgggatgggtcctgaccccattctccctcctgtccaggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaaaaaaaaagaaaaaaaccggcacattgtcgggaatactcgggaaaccgagaagaaccccacacaataaaatgggggtgccattccacaagcaggaagggattaaaacgacgaggtcctgcaaaacagcggttcaaaaaaaaggggggaatacgggagacgcactgtaggcataaattaacgcgaccgagg

SEQ ID NO: 439948 - DNA, 4473 bp, Homo sapiens
ggcacgagggccgacccctgagttaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaaaaaaaaagaaaaaaaccggcacattgtcgggaatactcgggaaaccgagaagaaccccacacaataaaatgggggtgccattccacaagcaggaagggattaaaacgacgaggtcctgcaaaacagcggttcaaaaaaaaggggggaatacgggagacgcactgtaggcataaattaacgcgaccgagg

SEQ ID NO: 439949 - DNA, 3031 bp, Homo sapiens
ttattcatcacgggcggcgttttatgcctagttgcggcccctggcctcaatgtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaaaaaaaaagaaaaaaaccggcacattgtcgggaatactcgggaaaccgagaagaaccccacacaataaaatgggggtgccattccacaagcaggaagggattaaaacgacgaggtcctgcaaaacagcggttcaaaaaaaaggggggaatacgggagacgcactgtaggcataaattaacgcgaccgagg

SEQ ID NO: 439950 - DNA, 4593 bp, Homo sapiens
cgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgtaagtcacctcaagcttattcagagtctaataaaggaaaatggccattgtcacctcatcaagtccttcactataattactgttaggtcttctcctacttcttctagccttgactgcgctgccttattttctttcatccagcatctaatcttcctcttgccaccgccctttcctgccaaaccgtgggtaacagcaaggacttaaaggagcccttcccatttacttctcttacttcttaccctcctgcttccccaggatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtagcctggaaaaattttgggaatggtgggaagaaatagtaagaaacttgggatagagcattttttaaggaagctaaagaagtagtgggtaaaaattcagatcctaagaattggagcatctctgggagggctttctgactccaagctaaactattgtttgacacatcctctctcatttccatttttttactctttcccctcagctcctttgtctagcagatctaattatgcttgaaaaaaaaacctgctacttaggatctttgagttccagcttattggtgtttctcagctgcaatgttgggagagaaataggggtagaatgtccattcatgatagaatgtctgttcatgagttgggatgggtcctgaccccattctccctcctgtccaggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaacgtgagacccctctccccacctctagatgctggattatcccatggtcctcagatttcttttaacatactctataagcccttttcttgttataaactcttgatctcaaag

SEQ ID NO: 439951 - DNA, 3601 bp, Homo sapiens
cgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggtaagcagtggcagaacactctgagagctatggctttaactttggtgcagtaacaatgcagtctcaccatgagtctttgcatgtagattattctacttgatggatatttctgtggccacctcgttatctctccccctaactagcacattcctagtgtttgtttaaagaaccaaattattgaccgggcacagtggctcacacctgtaatcccaacactttgggaggccgaggcaggtggataacttgaagttcaggagttggagaccatcctggccaacatggtgaaaccccgtctctacta

SEQ ID NO: 439952 - DNA, 3607 bp, Homo sapiens
cgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggtaagcagtggcagaacactctgagagctatggctttaactttggtgcagtaacaatgcagtctcaccatgagtctttgcatgtagattattctacttgatggatatttctgtggccacctcgttatctctccccctaactagcacattcctagtgtttgtttaaagaaccaaattattgaccagccaccgcacccggcctcctgaattaacattttctaaagatgcttctggcgtgctatcctgaaagctgccagaggtgtcttggctgcattggtggtaataaaattcatactcaaatttgaaaa

SEQ ID NO: 439953 - DNA, 805 bp, Homo sapiens
cctggttcttatttgatcctgtccttaaacctacagcacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaaaaaaaaagaaaaaaaccggcacattgtcgggaatactcgggaaaccgagaagaaccccacacaataaaatgggggtgccattccacaagcaggaagggattaaaacgacgaggtcctgcaaaacagcggttcaaaaaaaaggggggaatacgggagacgcactgtaggcataaattaacgcgaccgagg

SEQ ID NO: 439954 - DNA, 658 bp, Homo sapiens
gtcagtcttggtgacagtgacattgaaggtgggggcccaccggtgctctggtacgaagatccatgctaaattccccatcctgcagcagtgagtcccggatcaccgaacatttctggccccctgcatgccacccagaatgcatgcggcgcccaggatgcatgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaagattgtggttttgtttctctctctcagcccgatactcccaattctggatctttcagtgaggtattatccccatcctcccctgtgggc

SEQ ID NO: 439955 - DNA, 462 bp, Homo sapiens
tcctgccctcaagcgaccctcctgcctcggcctctaaaagtgctgagattacaggtgtaagccactgtgccagcccaaaacattattttcagtagctctctactgcttaatgaatgttctccatgccgtctcaaactcttaaatctttttcaggagtgttagcgtacagcagaagataagaactcttaaaaatctcagcatcagattctggagaatagggagggagaacatggaatatttgaatagaataacaggcagcagagtaggaattagttttattagggaactgaaattctctattgattgattgtagttataaggactccaatttaatttgttttctgttccatgcagaggacaaaagcatgtcttcccttcctgggtgcattggtttggatgcagcaacagctacagtggagtctgaagagattgcagagctgcaacaggcagtggttgaggaac

SEQ ID NO: 439956 - DNA, 529 bp, Homo sapiens
ttatttgatcctgtccttaaacctacagcacagttgcagccccaacctgtttgtccagaatgtcttcgtggatacccatgatcttcgcttcccctgggtggccttctttgccagcaagtaaggagtcaggaaaggggatgactggggaggggcaaggaccactgaagttctaagggcccctcctccattcatgatccaactccacctacatattcagtaaccccaagtgcctgggttatctgctgtctttgccacacaccatccttttcttcctcttcagaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatggggg

SEQ ID NO: 439957 - DNA, 389 bp, Homo sapiens
agcctaggcaaaaagagcgaaactgtctcaaaaaaaaaaagagaaatagagatgttatcagtcagtgaagagtaaccagggagtttcattgtccaggtttggtagggcaagggaagatctttcttgaatcatctttagcttcaggagcacagctgtttgaaagatgagagaaatggcttagctacctggagggttaattataaaacagaggtcctgttgccttccgatctgatcacttgcatctcatttgcagatcacctttaggctccacagcctctgccccagcaccctcagcactcccggcccctccagcacccccagtcttccatggcatgctggagcgggccccagcagagccctcctaccgtgctcccatggagaagcttttc

SEQ ID NO: 439958 - DNA, 4609 bp, Homo sapiens
cgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaaaaaaaaagaaaaaaaccggcacattgtcgggaatactcgggaaaccgagaagaaccccacacaataaaatgggggtgccattccacaagcaggaagggattaaaacgacgaggtcctgcaaaacagcggttcaaaaaaaaggggggaatacgggagacgcactgtaggcataaattaacgcgaccgagg

SEQ ID NO: 439959 - DNA, 5099 bp, Homo sapiens
cgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaaaaaaaaaaaaaaaaaaaaaaaaacaaacaaaaaaaaaaaaaacaaacaaaaaaaaaacgcagacggcgagcagcgcgagagaagacgaagaacgagaagaaaggctcgacgaagacacgacgacgagaagcggaggaggagcggcccacaccaccggagggcgcccgcgcgccacagcggcgcgagacgcgcgcgaccgcggcggacagacaggcggcgccacccaacacaacacaggcacgggagagaccatacgtaacacaagaagaagacagacaagccggaagcgacgggagaagaagaaaccacagacgcagaccccggagaagcagcgacgagccggacaggccgagaagaaagaacgaacacacgccgacaagcccgcgcgcacccagacaacccgagaagtaggccgcacgacggcgaccacgacagcgaaaagaccaacgacacaaaggaaaaagagaagcaggcggagggcggagggcgggaacacgagaggacagacaagaacagcagagaacgcaacagacaacgcagcgtaacgagcagagaccaaggccaaaaatacgacgacagcagagggagagaacgacagcagcggacgacagcgaaccaaacggaagagacggaggagcgcggaagcaagcaagcccccagggcagcaacgagggaggaa

SEQ ID NO: 439960 - DNA, 4864 bp, Homo sapiens
cgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgtaagtcacctcaagcttattcagagtctaataaaggaaaatggccattgtcacctcatcaagtccttcactataattactgttaggtcttctcctacttcttctagccttgactgcgctgccttattttctttcatccagcatctaatcttcctcttgccaccgccctttcctgccaaaccgtgggtaacagcaaggacttaaaggagcccttcccatttacttctcttacttcttaccctcctgcttccccaggatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaaaaaaaaagaaaaaaaccggcacattgtcgggaatactcgggaaaccgagaagaaccccacacaataaaatgggggtgccattccacaagcaggaagggattaaaacgacgaggtcctgcaaaacagcggttcaaaaaaaaggggggaatacgggagacgcactgtaggcataaattaacgcgaccgagg

SEQ ID NO: 439961 - DNA, 3609 bp, Homo sapiens
agagttccaagttttaatatggtgcttttaagaagagagccaccggtctcagcttataattacattttcacaaattaatccaaaattttacgtatgaataaaaaggagtaaaatcttttccctatcaagacatgccctacctgccctctcagttctacttcttccttgaaacagagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaaaaaaaaagaaaaaaaccggcacattgtcgggaatactcgggaaaccgagaagaaccccacacaataaaatgggggtgccattccacaagcaggaagggattaaaacgacgaggtcctgcaaaacagcggttcaaaaaaaaggggggaatacgggagacgcactgtaggcataaattaacgcgaccgagg

SEQ ID NO: 439962 - DNA, 2107 bp, Homo sapiens
cttaaacctggaagccaaaagttccattaacccaaaatcccccccccccccccccccctgggggaaaaaaaaaaatccatctggaaaaaaaaaaaaaaaaaagcaaacaaaaaaaaaaactaataggtccccataaccctagaaggcctttaattctcttcattctcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaaaaaaaaagaaaaaaaccggcacattgtcgggaatactcgggaaaccgagaagaaccccacacaataaaatgggggtgccattccacaagcaggaagggattaaaacgacgaggtcctgcaaaacagcggttcaaaaaaaaggggggaatacgggagacgcactgtaggcataaattaacgcgaccgagg

SEQ ID NO: 439963 - DNA, 1166 bp, Homo sapiens
catctgctgagtccgtttagaagcatttgcggtggacgatggaggggcccgactcgtcgtactcctgcttgctaatccacatctgctggaaggtggacagtgaggccaggatggagccaccgatccacaccgagtacttgcgctctgggggtgcgatgatcttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaaaaaaaaagaaaaaaaccggcacattgtcgggaatactcgggaaaccgagaagaaccccacacaataaaatgggggtgccattccacaagcaggaagggattaaaacgacgaggtcctgcaaaacagcggttcaaaaaaaaggggggaatacgggagacgcactgtaggcataaattaacgcgaccgagg

SEQ ID NO: 439964 - DNA, 1531 bp, Homo sapiens
cgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggtactgttcttctctacaattttggaggcagaggttggtggggggggaacttaagaagcagtaatgaggatggttttatagctattccatagccttcctctttcttatcctcgtatgtgttctcactgtttttggtcaaattttactttgccctttttgttgttcctctgcaggtcattgttgaaaataaattatctgaattataatacgaatctgcatg

SEQ ID NO: 439965 - DNA, 1460 bp, Homo sapiens
cgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggttagggtcaagaaatacctgggtacagatgggaggtgaattcttacagagattttgtcttaagtcttatgtctgctaattgtttgtgacatgccagactcagtatccttagtagttatgaaatcccagttacattgatggtgatttttccagtctgtgatggttttatctcaatacctctttagcgtcctacatttaggctgtttccatcctcatgactgcttccaggtggagattagggagaagagaatcactcagactcttgttacaaaaaggtttgaggccaggtgtggtggctcatatctgtaattctagcagctttgggaggctgaggcaggaggatcacttgaggcccagcattaaagaccagcctcggcaacatagtgaaaccccatctctacaaaaaaaaatgtttaaaaattctccagatgggccaggcacggtggctcacgcctgtaatcccagcactttgggaggccgaggtgggcggatcacaaggtcaggagttcgacaccagcctgaccaacatggtgaaactctgtctctattaaaaatacaaaaattagccaggcgtggtggcgcacgcctgtaatctcagctactcaggagcccgaggcaggagaatcgcttgaacccggaaggtgaaggttgcagtgagccgagatcatgccactgcactccagcctgggcaacagaacgagactccatctcaaaaaaaaaaaaaaaaattggccgggcacag

SEQ ID NO: 439966 - DNA, 871 bp, Homo sapiens
ttaaatgctgatgggggggagatataaataataagagacaaacctatcttcaaaaagactagtaatgtgaaataaacatttgcatgaaacagtaggattgaagaataagaacaaaagagcactacgtgtgagaagctcacttgaaagtcccaaattgaaataaacactgttttgatgagaaggggcctcctttttaatattctttccatgtggaatcatcagcagtaaagagatctatagatctggaagcagaagagctggctggatggaggggactttgctgacatcccctctgaaaaataaggtcagaagagtgggcccagggggagggtgattttcatgatccgtggcatttcattacccttgtaaacagatactggagctgtgctcatagccaaactggaaaactagattatttagcaggttttctttccatagctgagccataatcttcccttaggagagatactgtatcttatccttgatggtacagtcagtgcctagaactgaaaaactactcaataaatggatttgttgttttgtgataaggatgatgtcttcttactttgcccaagcctggaaagtaggccaaatatataatagagtttctttcatcttcccagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcagtaagtcactttcttatcattccccatttcgaggctctcacttgaccacacaaatttaataaatttttcttggtgtttaaattttcttttataaactca

SEQ ID NO: 439967 - DNA, 1580 bp, Homo sapiens
caggagagcggtaggggtgatgtcatcgctgcgcgacgacaggaagtaagatcctggcctgtgcagctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcggaggaaggcgagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcaaatcctggtttcttctttttctgaggagcagctgaaccgttatgaaatgtatcgccgctcagctttccctaaggcagccatcaaaaggctgatccagtccatcactggcacctctgtgtctcagaatgttgttattgctatgtctggtatttccaaggttttcgtcggggaggtggtagaagaagcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgc

SEQ ID NO: 439968 - DNA, 1548 bp, Homo sapiens
  misc_feature (30)..(30): n is a, c, g, or t
ggctaggtacgaggctggtgtgaatcggcngaggctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcggaggaaggcgagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcaaatcctggtttcttctttttctgaggagcagctgaaccgttatgaaatgtatcgccgctcagctttccctaaggcagccatcaaaaggctgatccagtccatcactggcacctctgtgtctcagaatgttgttattgctatgtctggtatttccaaggttttcgtcggggaggtggtagaagaagcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgc

SEQ ID NO: 439969 - DNA, 1900 bp, Homo sapiens
ttaaatgctgatgggggggagatataaataataagagacaaacctatcttcaaaaagactagtaatgtgaaataaacatttgcatgaaacagtaggattgaagaataagaacaaaagagcactacgtgtgagaagctcacttgaaagtcccaaattgaaataaacactgttttgatgagaaggggcctcctttttaatattctttccatgtggaatcatcagcagtaaagagatctatagatctggaagcagaagagctggctggatggaggggactttgctgacatcccctctgaaaaataaggtcagaagagtgggcccagggggagggtgattttcatgatccgtggcatttcattacccttgtaaacagatactggagctgtgctcatagccaaactggaaaactagattatttagcaggttttctttccatagctgagccataatcttcccttaggagagatactgtatcttatccttgatggtacagtcagtgcctagaactgaaaaactactcaataaatggatttgttgttttgtgataaggatgatgtcttcttactttgcccaagcctggaaagtaggccaaatatataatagagtttctttcatcttcccagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcaaatcctggtttcttctttttctgaggagcagctgaaccgttatgaaatgtatcgccgctcagctttccctaaggcagccatcaaaaggctgatccagtccatcactggcacctctgtgtctcagaatgttgttattgctatgtctggtatttccaaggttttcgtcggggaggtggtagaagaagcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgc

SEQ ID NO: 439970 - DNA, 1483 bp, Homo sapiens
caggagagcggtaggggtgatgtcatcgctgcgcgacgacaggaagtaagatcctggcctgtgcagctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcggaggaaggcgagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcaaatcctggtttcttctttttctgaggagcagctgaaccgttatgaaatgtatcgccgctcagctttccctaaggcagccatcaaaaggcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgc

SEQ ID NO: 439971 - DNA, 1741 bp, Homo sapiens
tctaataccattctttttttaatagtggtctgatttatgaaaaatgttatctatgaaaataatatttccttagttaataatgaaggttgtttcccccatgttgattgaccattggtattttggtaaatttcctgttcatgtactttgttcattttcaaaaattgacatggcccctttattcatttgaaagaattatacattaggagtattaactgtttccacatattttgcagatatttcccctaaatctgttaatgttgaaaactactggtttgattataaatttgtatattaaatttttaccatcagtgtgaaattcaataagatagagttatggagatagtgtctaatgctgcaaacagtctgtgtagtacgatacagtgacccagtgttgttctttttgttaacaggtaagaaaagaagtttttgttttacgttttctcaaattcctttggagtagaagtgttttatcttcattcctcaaggcaccaagcctaatgccattgacccctttaagaattcgtttttgaattgtctgaaacttttattgacttcataatatcttgagtattcgttcttataagttaacttagttacctggatctttgtttagaatcctggtttcttctttttctgaggagcagctgaaccgttatgaaatgtatcgccgctcagctttccctaaggcagccatcaaaaggctgatccagtccatcactggcacctctgtgtctcagaatgttgttattgctatgtctggtatttccaaggttttcgtcggggaggtggtagaagaagcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgc

SEQ ID NO: 439972 - DNA, 1091 bp, Homo sapiens
ttaggctaggtacgaggctgggtgtgcttccctaaggcagccatcaaaaggctgatccagtccatcactggcacctctgtgtctcagaatgttgttattgctatgtctggtatttccaaggttttcgtcggggaggtggtagaagaagcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgc

SEQ ID NO: 439973 - DNA, 904 bp, Homo sapiens
  misc_feature (30)..(30): n is a, c, g, or t
ggctaggtacgaggctggtgtgaatcggcngagggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgc

SEQ ID NO: 439974 - DNA, 384 bp, Homo sapiens
  misc_feature (30)..(30): n is a, c, g, or t
ggctaggtacgaggctggtgtgaatcggcngaggctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcggaggaaggcgaggcaggaagagatgtactgatgaggctgaaggaatacccagagattgtgttactggctgctcgccgggcttctggttagtccctaacaagttacgagaactcgaactcaccaga

SEQ ID NO: 439975 - DNA, 1700 bp, Homo sapiens
caggagagcggtaggggtgatgtcatcgctgcgcgacgacaggaagtaagatcctggcctgtgcagctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcggaggaaggcgagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcaaatcctggtttcttctttttctgaggagcagctgaaccgttatgaaatgtatcgccgctcagctttccctaaggcagccatcaaaaggctgatccagtccatcactggcacctctgtgtctcagaatgttgttattgctatgtctggtatttccaaggttttcgtcggggaggtggtagaagaagcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgcaaaaacacaaccaaccaaacctcccggcccttctttgcgggggacaaagtaaacggccccggcacgttccggccccgctttgtaaggggatgcgccccaaggggcgtatcgaacggtcgc

SEQ ID NO: 439976 - DNA, 2557 bp, Homo sapiens
caggagagcggtaggggtgatgtcatcgctgcgcgacgacaggaagtaagatcctggcctgtgcagctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcggaggaaggcgagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcaaatcctggtttcttctttttctgaggagcagctgaaccgttatgaaatgtatcgccgctcagctttccctaaggcagccatcaaaaggctgatccagtccatcactggcacctctgtgtctcagaatgttgttattgctatgtctggtatttccaaggttttcgtcggggaggtggtagaagaaggtgagtagtgttggttacaaatactggattgtacctgtggtggtcttatttttaagaatatctacacaaaggagcttattaaagcacctatgggagttctcatttgcacttgaagttgaccaagtggggagccctttatttaggagaacatgactgttattccttgcaagtttcaataacagatggtaaggaaccatctgggaaatcccctccctgattcctttcctcagcccagggtgaaagaagtagactttgtattttctgcagtggactttgctcatttctgctgccaaaagtaaagatacaagaaaagcaatcacaggggtgacctgtgtgggatggtgagttgtccctaatgttgtgatccctaggaactgcctgacccctttattgagtaaaaagcctggctgtttcccattgctactctagctggtgaaattttttttttttttttgagcaggagatatatacttttaaattattattattttttgagacagggtctcactctgtcacccaggctggagtgccttgatcatgcgatcacagctcactgtaacagttagctcctgggctcgggtgattctcctgcctcagtctgagtagttgagaccacaggtgcgcaccaccacccctggctaactttttaattttttgtagagacaaggtttggccatgttgcccaggttggtctcgaactcctaggctcaagcaatcctcccaccttggcctccctaactgctgggattataggcatgagccacagcatatggcctataggaaatatattttaaactgttgtctatgataaagcctgttatgagacgttatactaatattctcttaaaaaggaaaaatgtctgtttatttccttagcaagcttaagaaaagttaacaagaattacaggactcaaaaggattatgtgattagtaaattattgtgtgataatcagactttctccttaccctctgtttagcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgc

SEQ ID NO: 439977 - DNA, 1507 bp, Homo sapiens
caggagagcggtaggggtgatgtcatcgctgcgcgacgacaggaagtaagatcctggcctgtgcagctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcggaggaaggcgagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcaaatcctggtttcttctttttctgaggagcagctgaaccgttatgaaatgtatcgccgctcagctttccctaaggcagccatcaaaaggactttctccttaccctctgtttagcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgc

SEQ ID NO: 439978 - DNA, 5053 bp, Homo sapiens
atgaggacacttgggacttgcctggcgactttggccggacttttgctaactgcggcgggcgagacgttctcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaattcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggaatacaatggcggggaaggccgcaccgttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaa

SEQ ID NO: 439979 - DNA, 5302 bp, Homo sapiens
agcgggtgctgtggcccaatcctgtgcgtgtctcctcttcagggctcctgccggagcatgcttctctaatcttaccatttatcactgacccttcggtgaaactctcttctgtttaaatttaccaggtacactttgtaatacttgggaccaagaatttgaagatagtaatcagacaaatcaaacaactagtagtagtggagagacacgtagccctacaggaaggggtagaattatcattaaaaacacagacaaaaccagagactgcctgaaaaacatgatacctgatgaactggaaaggatccaaagtaggctctatgggcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaattcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggaatacaatggcggggaaggccgcaccgttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaa

SEQ ID NO: 439980 - DNA, 5353 bp, Homo sapiens
agcgggtgctgtggcccaatcctgtgcgtgtctcctcttcagggctcctgccggagcatgcttctctaatcttaccatttatcactgacccttcggtgaaactctcttctgtttaaatttaccaggtacactttgtaatacttgggaccaagaatttgaagatagtaatcagacaaatcaaacaactagtagtagtggagagacacgtagccctacaggaaggggtagaattatcattaaaaacacagacaaaaccagagactgcctgaaaaacatgatacctgatgaactggaaaggatccaaagtaggctctatgggcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaattcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagggaggggccggaggtgaagcaaactgcagtccatccagagaagtgtcacagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggaatacaatggcggggaaggccgcaccgttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaa

SEQ ID NO: 439981 - DNA, 3354 bp, Homo sapiens
atcaccagaattaacaatgaatctttcagcaccacactcaatttcaattggaaacactgctcagtcttcacctttatttaggatgaatgtttttggttttgttttcctttttttcttcttcagttgatctatccaagatctcagccaaaccttgcaactgtgtcatagttagaaatccaactgcctgactagagcttgtttaagggaaaagaattcagaatattcagcaccttgctatgttttttttttctttttttccttttctttttgttgttgttagaacaaagttgagacaatttgatatactgatggggattcttcttgctagcctagcttcagtctggcttttttttccctcatgcatgctgacctggaaatcctcctttgccttagctgcgataatcgtgactcagcttacaacaccttacattcgcatcgcccccgctgcaggcgacggccaactaacaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggaatacaatggcggggaaggccgcaccgttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaa

SEQ ID NO: 439982 - DNA, 2044 bp, Homo sapiens
tactgccctcaaaaacatacactccgctgtaacaataacgagggtcacgggccacaaaatattaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggaatacaatggcggggaaggccgcaccgttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaa

SEQ ID NO: 439983 - DNA, 5332 bp, Homo sapiens
agcgggtgctgtggcccaatcctgtgcgtgtctcctcttcagggctcctgccggagcatgcttctctaatcttaccatttatcactgacccttcggtgaaactctcttctgtttaaatttaccaggtacactttgtaatacttgggaccaagaatttgaagatagtaatcagacaaatcaaacaactagtagtagtggagagacacgtagccctacaggaaggggtagaattatcattaaaaacacagacaaaaccagagactgcctgaaaaacatgatacctgatgaactggaaaggatccaaagtaggctctatgggcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaattcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggaatacaatggcggggaaggccgcaccgttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattttttccatgtgtttatattgtaaatatttttgatttcatcaaattatttattcattaaaagaaatttttgtgaagcacagtgagtgacaatcatttttcttaaggcctggaaacgattttctgtatgatgttactttatgtgaattctcatctcaataaatgatgacccgtgagcagccgtg

SEQ ID NO: 439984 - DNA, 1842 bp, Homo sapiens
tgtggtggtttgtattgggtccgattggttttaatcaatctgtgtaatatttggcattgcaccccagtctcctagcacttgagcccttggaccgtgtttctctctggaggaactgtctccactctcttgatgatgtggggctaaaattgataccgtctttcctccttctctggttctctaaagttagtaactcgttccatctccttctccaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggaatacaatggcggggaaggccgcaccgttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaa

SEQ ID NO: 439985 - DNA, 254 bp, Homo sapiens
gcggagttccttcatcccttcagtggattcaggatttcaagagtctgagtaggagcttatcataaagtgtctgacagtgcatacatcagaagggtttattggataaagatgcaatctgagtccatctgctccagatattttatcactttctcattcttttgcagatcacctacaaagcagtcagttcctttgacccagaaatagatttatccaatcagagtggaagagtttcaaagctgggaaatgaaacccat

SEQ ID NO: 439986 - DNA, 5161 bp, Homo sapiens
atgaggacacttgggacttgcctggcgactttggccggacttttgctaactgcggcgggcgagacgttctcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaattcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggaatacaatggcggggaaggccgcaccgttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaagcacagtgagtgacaatcatttttcttaaggcctggaaacgattttctgtatgatgttactttatgtgaattctcatctcaataaatgatgacccgtgagcagccgtg

SEQ ID NO: 439987 - DNA, 4490 bp, Homo sapiens
tgcccaagctgaagctgcctgggaggaagggctgagcatgcctagcccagccccttctttggggagctgactgcctatgggaaccctctccctccatcctggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaattcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggaatacaatggcggggaaggccgcaccgttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaa

SEQ ID NO: 439988 - DNA, 2273 bp, Homo sapiens
acatgatcaatcagctcggtaccagatataaatttaccgattgagtcacaagaagccacagaaatcacagctcatatcaatggcatctactctcgctgcgtttatcatcgacccaaacattacattgtgtacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggaatacaatggcggggaaggccgcaccgttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaa

SEQ ID NO: 439989 - DNA, 5224 bp, Homo sapiens
agcgggtgctgtggcccaatcctgtgcgtgtctcctcttcagggctcctgccggagcatgcttctctaatcttaccatttatcactgacccttcggtgaaactctcttctgtttaaatttaccaggtacactttgtaatacttgggaccaagaatttgaagatagtaatcagacaaatcaaacaactagtagtagtggagagacacgtagccctacaggaaggggtagaattatcattaaaaacacagacaaaaccagagactgcctgaaaaacatgatacctgatgaactggaaaggatccaaagtaggctctatgggcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaattcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggaatacaatggcggggaaggccgcaccgttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattttttccatgtgtttatattgtaaatatttttgatttcatcaaattatttattcattaaaagaaatttttgtgaa

SEQ ID NO: 439990 - DNA, 3735 bp, Homo sapiens
agcgggtgctgtggcccaatcctgtgcgtgtctcctcttcagggctcctgccggagcatgcttctctaatcttaccatttatcactgacccttcggtgaaactctcttctgtttaaatttaccaggtacactttgtaatacttgggaccaagaatttgaagatagtaatcagacaaatcaaacaactagtagtagtggagagacacgtagccctacaggaaggggtagaattatcattaaaaacacagacaaaaccagagactgcctgaaaaacatgatacctgatgaactggaaaggatccaaagtaggctctatgggcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaattcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggtactcccgctcatcacctagcctggggccttggtccctgggctccctcctgcatctccccat

SEQ ID NO: 439991 - DNA, 2644 bp, Homo sapiens
agcctcagaaagagataatctgtgaaagccacagagcctgatttctgctgtgataatcttcagcagaccgaggctggggcgagaatgaggcagacctgtttacatggtgtgtgcagtgccttgtggaattcttaactctattttattgtattatttttaatcgaaaagtagatcagatgatagcatgaagtgaatcggctgctttggactaatgggatcttcttttctgcattaagatcaagaacttttctggaatcctctgttctccgagtagccttgtcttctctgtgtgttttatcaatttgaagaacactggcaaaaatcagcaaacttcatctcccaaaaagctctcgctcttttttgccaatacttgaagatttctgctccaaaatctactttgagctgcttgagcatggtggttgataaccgaagggcaaaagcatcacttatttagtgtgtgttatagaaattttttagacaaccttactagctaacccaggtgaccctttacggacggctttcaaagccaatttgaataaacaactcttccctctcaaatgggcaagagtaactcttcagcaccatggagaggtccgggcagcgtgttacaacgtgggactgtgaccagggcaagcactctgacagtgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcaaaaaaaaaaaa

SEQ ID NO: 439992 - DNA, 2605 bp, Homo sapiens
agcctcagaaagagataatctgtgaaagccacagagcctgatttctgctgtgataatcttcagcagaccgaggctggggcgagaatgaggcagacctgtttacatggtgtgtgcagtgccttgtggaattcttaactctattttattgtattatttttaatcgaaaagtagatcagatgatagcatgaagtgaatcggctgctttggactaatgggatcttcttttctgcattaagatcaagaacttttctggaatcctctgttctccgagtagccttgtcttctctgtgtgttttatcaatttgaagaacactggcaaaaatcagcaaacttcatctcccaaaaagctctcgctcttttttgccaatacttgaagatttctgctccaaaatctactttgagctgcttgagcatggtggttgataaccgaagggcaaaagcatcacttatttagtgtgtgttatagaaattttttagacaaccttactagctaacccaggtgaccctttacggacggctttcaaagccaatttgaataaacaactcttccctctcaaatgggcaagagtaactcttcagcaccatggagaggtccgggcagcgtgttacaacgtgggactgtgaccagggcaagcactctgacagtgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcaaaaaaaaaaaa

SEQ ID NO: 439993 - DNA, 1232 bp, Homo sapiens
  misc_feature (1097)..(1097): n is a, c, g, or t
ggtaggaaggatgatgccggaggttagaaatgttcaactgcaacattgatttgtgtctgtccctctccctctccctcgctggcctttttctcgttaatgaggactagaatgtttccacatcagttaactgccttcataaagcaccagaaggtcacaccagctccagactgatccttttctttgtgcctataatataattggctgattgtgcgggtgatgagcgccccctcccccagcccggtcccagctccatgttcctaagcctgcctcactggtttcggagggctggagagcagctcagctcgctagctgcgcgcttcccggcacaggcagtgccactgcgcaggttgatcagcgaaacagcatccattttaatctgcggggagcccctgccttaccagggcgttctctccgcccgccggtggatgctccgcgcctgccctccgcagcctcgctcagcagtcctgcgttggggtctgcgccctaggatgcactgagatggtacatcaggataactgctcgtatcaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaaaggttgaantgaacgaagttggccccgcgtgcttctccatcccgagatgagctggacacaggagactggaatgccatgctgggtggaacttggtagactgtgccaggacatcctggaactctagcggaagccgttgggagaaac

SEQ ID NO: 439994 - DNA, 1178 bp, Homo sapiens
ggtaggaaggatgatgccggaggttagaaatgttcaactgcaacattgatttgtgtctgtccctctccctctccctcgctggcctttttctcgttaatgaggactagaatgtttccacatcagttaactgccttcataaagcaccagaaggtcacaccagctccagactgatccttttctttgtgcctataatataattggctgattgtgcgggtgatgagcgccccctcccccagcccggtcccagctccatgttcctaagcctgcctcactggtttcggagggctggagagcagctcagctcgctagctgcgcgcttcccggcacaggcagtgccactgcgcaggttgatcagcgaaacagcatccattttaatctgcggggagcccctgccttaccagggcgttctctccgcccgccggtggatgctccgcgcctgccctccgcagcctcgctcagcagtcctgcgttggggtctgcgccctaggatgcactgagatggtacatcaggataactgctcgtatcagatggagtcttgctccgttgcccaggctggtgtgctgtggcgcaatcttggctcactgtaacctccacctcccgggttccagcgattctcccaccttagcctcctgagtagctgagattacacgcgtccaccaccatgcccagctaattttctgtatttttagtagaaacgggttttcaccatgttggccagactggtctcaaacttctgactttaggtgatctgcccaccttagcctcccaaagtgctgggatcacagtcgtgagccaccgcgcctggccgacaacaggcttcttgaagacaaggggccttctttaaattttcacaagtctctgccttatacacagagtatgtgttcaataaatgtttgttggattgaattgcactttatgcaattgttgatgttctgagtccctaggatcagggtttcccatcgtaaccccagagataagctcagatccatacgttgtaacaaggagttggtgaagctgacctcagaagtccatgtacctggcttctcagcctcttggccagttgcccgcactttaaacatctcatgtgccagaatgggggtgcagtgcaaggcacaaaataaatgaatgactgggatgcacagacattccagccttcccagagacaatgcattaagaa

SEQ ID NO: 439995 - DNA, 2091 bp, Homo sapiens
caccccgagccttccggcgggtgggaggaggggccggccagggagacgcggaggcgggagtgagacctccgactgccagcggttccttacaaagattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcaaaaaaaaaaaa

SEQ ID NO: 439996 - DNA, 2442 bp, Homo sapiens
gatgcctagagtgagctcaactcaaaggtttccagcctcacactcgcctcacattcccccacagtcacattgcgctctgtgattctgaggaatacagtgtgccagcatccgatccagtctcctttcacctgcaggtgttccagaaacttcaaaatgcgtctggaagaactgaaaagattgcagaatcctctagaacaagttaatgatggaaaatattcatttgaaaatcaccagctggccatggatgcagagaataatattgaaaagtatcccctcaatctacagcccttggaatcaaaggtgaaaatcattcagcgagcatggcgagagtacctgcagcggcaggagcccctggggaagaggagcccgtccccaccctctgtctcctcagagaagctgagcagctctgtcagcatgaacaccttctccgacagcagcacacccgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcaaaaaaaaaaaa

SEQ ID NO: 439997 - DNA, 1789 bp, Homo sapiens
cacactcggccctgaacgcggagttgaatcagctggctgaagctgagtgcctctcttttcctttcttgggaacaggaaaggtgctgtggagaggaattggggcgggatcattcaggggaaggtgacagcagatggtgggaaggccggagtcagcaagccaagtgtcaggggcagagtgagcctcagaaaacagcagctgcccggtgccagagcaaggaaaggccagggaggctgggcggggcagtgtctgtgggacagagtggggcaagaacacacacggccgggcacagcctcttagccagctctccatgtcagtatgagcagtaaccaggaactgggcaattggcacatcagcctatcagaattcatgggaggttatttcttaagtgaaattctaaagagttaaaggatgaatttggacagtgatggaatggatgacatcatcagtcaagaatcctcattggatatggaggggaattataaaaaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcaaaaaaaaaaaa

SEQ ID NO: 439998 - DNA, 1718 bp, Homo sapiens
taatttcctgggaaagtgtctggttctcggagaatccttggggcggggtaaaggggcgcgcctggcgcaaaatggttaatacaaagtctgcgcgcgccgcggggccccttgtatgaaaagtgtgcgcgctggtggctgggcacccctttgctaatttgagggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccggcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcaaaaaaaaaaaa

SEQ ID NO: 439999 - DNA, 1389 bp, Homo sapiens
ggtaggaaggatgatgccggaggttagaaatgttcaactgcaacattgatttgtgtctgtccctctccctctccctcgctggcctttttctcgttaatgaggactagaatgtttccacatcagttaactgccttcataaagcaccagaaggtcacaccagctccagactgatccttttctttgtgcctataatataattggctgattgtgcgggtgatgagcgccccctcccccagcccggtcccagctccatgttcctaagcctgcctcactggtttcggagggctggagagcagctcagctcgctagctgcgcgcttcccggcacaggcagtgccactgcgcaggttgatcagcgaaacagcatccattttaatctgcggggagcccctgccttaccagggcgttctctccgcccgccggtggatgctccgcgcctgccctccgcagcctcgctcagcagtcctgcgttggggtctgcgccctaggatgcactgagatggtacatcaggataactgctcgtatcaggcacagaaaaatgagagagagtctatcagacagaagttggcacttggaagcttctttgatgatggcccaggaatttataccagctgtagcaaaagtgggaagccaagcctttcctcccggcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcaaaaaaaaaaaa

SEQ ID NO: 440000 - DNA, 1178 bp, Homo sapiens
ggtaggaaggatgatgccggaggttagaaatgttcaactgcaacattgatttgtgtctgtccctctccctctccctcgctggcctttttctcgttaatgaggactagaatgtttccacatcagttaactgccttcataaagcaccagaaggtcacaccagctccagactgatccttttctttgtgcctataatataattggctgattgtgcgggtgatgagcgccccctcccccagcccggtcccagctccatgttcctaagcctgcctcactggtttcggagggctggagagcagctcagctcgctagctgcgcgcttcccggcacaggcagtgccactgcgcaggttgatcagcgaaacagcatccattttaatctgcggggagcccctgccttaccagggcgttctctccgcccgccggtggatgctccgcgcctgccctccgcagcctcgctcagcagtcctgcgttggggtctgcgccctaggatgcactgagatggtacatcaggataactgctcgtatcaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaaagtctcccgtcgctgatcttgtaagcagcaaaggctgaaatgcaaggaagtgtttgggagccagaaatggttgacactgtcccagtcctttcccagaattatgcaaacttgtgtttctctaaggcggtttgtaaaaagtcctgtcattgagaaatgattaagtttgtttctttttccttcctactgtaggactgaaaaatacagaagcaatagatttcacaaaagtaaagtttg

SEQ ID NO: 440001 - DNA, 600 bp, Homo sapiens
ggtggcgggaggctggagcaggcttggcccagcagctcactctctacctcctccccctaggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctgggggg

SEQ ID NO: 440002 - DNA, 1830 bp, Homo sapiens
ggtaggaaggatgatgccggaggttagaaatgttcaactgcaacattgatttgtgtctgtccctctccctctccctcgctggcctttttctcgttaatgaggactagaatgtttccacatcagttaactgccttcataaagcaccagaaggtcacaccagctccagactgatccttttctttgtgcctataatataattggctgattgtgcgggtgatgagcgccccctcccccagcccggtcccagctccatgttcctaagcctgcctcactggtttcggagggctggagagcagctcagctcgctagctgcgcgcttcccggcacaggcagtgccactgcgcaggttgatcagcgaaacagcatccattttaatctgcggggagcccctgccttaccagggcgttctctccgcccgccggtggatgctccgcgcctgccctccgcagcctcgctcagcagtcctgcgttggggtctgcgccctaggatgcactgagatggtacatcaggataactgctcgtatcaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcaaaaaaaaaaaa

SEQ ID NO: 440003 - DNA, 1948 bp, Homo sapiens
agcctcagaaagagataatctgtgaaagccacagagcctgatttctgctgtgataatcttcagcagaccgaggctggggcgagaatgaggcagacctgtttacatggtgtgtgcagtgccttgtggaattcttaactctattttattgtattatttttaatcgaaaagtagatcagatgatagcatgaagtgaatcggctgctttggactaatgggatcttcttttctgcattaagatcaagaacttttctggaatcctctgttctccgagtagccttgtcttctctgtgtgttttatcaatttgaagaacactggcaaaaatcagcaaacttcatctcccaaaaagctctcgctcttttttgccaatacttgaagatttctgctccaaaatctactttgagctgcttgagcatggtggttgataaccgaagggcaaaagcatcacttatttagtgtgtgttatagaaattttttagacaaccttactagctaacccaggtgaccctttacggacggctttcaaagccaatttgaataaacaactcttccctctcaaatgggcaagagtaactcttcagcaccatggagaggtccgggcagcgtgttacaacgtgggactgtgaccagggcaagcactctgacagtgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcaaaaaaaaaaaa

SEQ ID NO: 440004 - DNA, 2159 bp, Homo sapiens
taatttcctgggaaagtgtctggttctcggagaatccttggggcggggtaaaggggcgcgcctggcgcaaaatggttaatacaaagtctgcgcgcgccgcggggccccttgtatgaaaagtgtgcgcgctggtggctgggcacccctttgctaatttgagggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcaaaaaaaaaaaa

SEQ ID NO: 440005 - DNA, 2030 bp, Homo sapiens
gatcctgtgtctgatccttgctggctgtgcaggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcaaaaaaaaaaaa

SEQ ID NO: 440006 - DNA, 1774 bp, Homo sapiens
ggtaggaaggatgatgccggaggttagaaatgttcaactgcaacattgatttgtgtctgtccctctccctctccctcgctggcctttttctcgttaatgaggactagaatgtttccacatcagttaactgccttcataaagcaccagaaggtcacaccagctccagactgatccttttctttgtgcctataatataattggctgattgtgcgggtgatgagcgccccctcccccagcccggtcccagctccatgttcctaagcctgcctcactggtttcggagggctggagagcagctcagctcgctagctgcgcgcttcccggcacaggcagtgccactgcgcaggttgatcagcgaaacagcatccattttaatctgcggggagcccctgccttaccagggcgttctctccgcccgccggtggatgctccgcgcctgccctccgcagcctcgctcagcagtcctgcgttggggtctgcgccctaggatgcactgagatggtacatcaggataactgctcgtatcaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggtgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcaaaaaaaaaaaa

SEQ ID NO: 440007 - DNA, 919 bp, Homo sapiens
cggacgcgtgggtcgacccacgcgtccggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcaaaaaaaaaaaa

SEQ ID NO: 440008 - DNA, 1923 bp, Homo sapiens
ccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttttctctcctaagacacctgcaataaagtgtagcaccctggta

SEQ ID NO: 440009 - DNA, 2200 bp, Homo sapiens
ccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttttctctcctaagacacctgcaataaagtgtagcaccctggtacatctgtgatgtttgccttctactctcttctgttccaaaaagacccaggtcccatttaagggcagtaatgtgttacaggtgctgtgataaaggctgggtactggatagcttgtgggcttatgggaggaggcctgagatgggtcagggggagaaggtattcagcaggtggctgggggactgtgtgcagcagttcgctatggcctgcctgtggtgcccatgtgtttgtacgggagggttagcttgagaaggaatcagattataaaaggtcttgaatgtc

SEQ ID NO: 440010 - DNA, 2482 bp, Homo sapiens
ccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtgatccaatccagaaacgtgcattacctttcctcgccatatctttttcgtcaccacctttaaactggaactgttttcccacctttgtcttttatgtcattgacgtttttgaagagtacaaaccagttttctgtagactctccctccgtttgagcttatctgacatttgctcgccgtgagatccaggccttgcatttgtactggaccctgttcttacacaccctgatccagcccacttgtgtagtctgggagtctgggacaacctccgtccgcccttctagccgggtcactgcaggcaagccttggtgctcttgcctgcgacgtggaaatgatgcctgcctgcagcgctgtatagtgcagagcgggcgaggggcatagggaagtcactggcacgtggtatgtgttggcagggctgcttctcaccccaaaccaagggagggacaggcagggaggctgagagcagcggcttgccctggagctgtcaggtgggaggcagagggcgggagaggctgtgggctgcccaggtctgatccctgacccacttgccacccgtgccctcagttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttttctctcctaagacacctgcaataaagtgtagcaccctggta

SEQ ID NO: 440011 - DNA, 2069 bp, Homo sapiens
ccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtcttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttttctctcctaagacacctgcaataaagtgtagcaccctggtacatctgtgatgtttgccttctactctcttctgttccaaaaagacccaggtcccatttaagggcagtaatgtgttacaggtgctgtgataaaggctgggtactggatagcttgtgggcttatgggaggaggcctgagatgggtcagggggagaaggtattcagcaggtggctgggggactgtgtgcagcagttcgctatggcctgcctgtggtgcccatgtgtttgtacgggagggttagcttgagaaggaatcagattataaaaggtcttgaatgtc

SEQ ID NO: 440012 - DNA, 2603 bp, Homo sapiens
ccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtgatccaatccagaaacgtgcattacctttcctcgccatatctttttcgtcaccacctttaaactggaactgttttcccacctttgtcttttatgtcattgacgtttttgaagagtacaaaccagttttctgtagactctccctccgtttgagcttatctgacatttgctcgccgtgagatccaggccttgcatttgtactggaccctgttcttacacaccctgatccagcccacttgtgtagtctgggagtctgggacaacctccgtccgcccttctagccgggtcactgcaggcaagccttggtgctcttgcctgcgacgtggaaatgatgcctgcctgcagcgctgtatagtgcagagcgggcgaggggcatagggaagtcactggcacgtggtatgtgttggcagggctgcttctcaccccaaaccaagggagggacaggcagggaggctgagagcagcggcttgccctggagctgtcaggtgggaggcagagggcgggagaggctgtgggctgcccaggtctgatccctgacccacttgccacccgtgccctcagttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggtaagggccagccctggctgctgcttcctcagctggaaggaccctccccagccctccctccccattctgtaccccccatcagctcccatttcggactctcttactgctgtcccttgtcactgggtgactccacccctggaatccagtaccccttggttcccaactaggactgttttccctcagtgttgctctaagcagcctctctccactgcccaatgccatgactgctccctgccctaggagatctgtggaccatgactgtccagtcagttctgggttcctggcatttcaggggcacccactgagaggcaagacagcctcagggaaacatggaatcaaggcagaatcaaggagatctggagtggcccgagggccctgactgcagcctagggctcatctaagactagcctgaagttggtcagataggatggcttcttctctatcaagaggccaggtgctgatgaaaataacactggccaggggcagaatccaaatcctaattctgttgctcactttctgagtgtccttgcacaagtcactcctccatgggcctcagtttcttcatctggaagcaaagaaataggatgaacggttgccttctcttttccagcacctgtcaaggtgccctcgggttttttcatagtacacagatgcttccagcctttctctgtctgatcccagccctcccccaaccaaagctcttgacagagaaccccctgccct

SEQ ID NO: 440013 - DNA, 1967 bp, Homo sapiens
ggagacagagtctcacactgttgcccagtctggatgcagtggtgctatcatagctcaccgcagtctcaacctccagggttcaaccaatcctcccaccacagcctcctgagtagctgggactacagatgcgtgtgaccacgcttggctaatgttttgatttttgtgtagagatgggttcccactatgttgcccaggctgagctggaacttctgagctcaagcgatcctcctgcctcagtctcccaaaatattgggattacaggcatgagccaccacgcctagcccattttatcacgtttgctttatcattttttctctgtagagaaatagccatagatacacacacacatacacacttagatgtagatatacattttctttctgtgtcttttgaaagtaggttgcagacatcatgtttctttaccccttaagtacttcccgaaacaaagcccttctgtagcataatcactgtatgattcttaagatcaggaaactcaacattgacacaatactacagtctacagtctatattcaaatttcaccaatagcctcaaaaatgtccataatagctcatgtttttttctgtccaggatccaatccagaaacgtgcattacctttcctcgccatatctttttcgtcaccacctttaaactggaactgttttcccacctttgtcttttatgtcattgacgtttttgaagagtacaaaccagttttctgtagactctccctccgtttgagcttatctgacatttgctcgccgtgagatccaggccttgcatttgtactggaccctgttcttacacaccctgatccagcccacttgtgtagtctgggagtctgggacaacctccgtccgcccttctagccgggtcactgcaggcaagccttggtgctcttgcctgcgacgtggaaatgatgcctgcctgcagcgctgtatagtgcagagcgggcgaggggcatagggaagtcactggcacgtggtatgtgttggcagggctgcttctcaccccaaaccaagggagggacaggcagggaggctgagagcagcggcttgccctggagctgtcaggtgggaggcagagggcgggagaggctgtgggctgcccaggtctgatccctgacccacttgccacccgtgccctcagttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttttctctcctaagacacctgcaataaagtgtagcaccctggta

SEQ ID NO: 440014 - DNA, 2565 bp, Homo sapiens
ggagctggcctgggctctgctctcctgggctggggcgcaggcagggctcaggcaggctggggctggacgcaaaggacctcaaacttggagggcctagctggggagagggtgcagccacccagtcgtttccctgtgtcttggagtctggtgtgggcacgaagggcagaagcacagcctggtggggggttcctcaacaccgaccccatgttcctggcaggagccagagtgacccctcgacctgtcagccatgggggagatggagcaactgcgtcaggaagcggagcagctcaagaagcagattgcagtaactccagagccctacccctggggccccagaaaacagctggggacatgaggagcgtggcccagggggagggggctgggtttgctcttgagtgactagaagtgaccagggactttctaaacttggttcgcatatttgagacccccaagccccagagccccaagaccaacctgccctgaaggcccatgcacctgccacccccacctcgcccttgctcccctgatgtctgctttccctgcaggatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtgatccaatccagaaacgtgcattacctttcctcgccatatctttttcgtcaccacctttaaactggaactgttttcccacctttgtcttttatgtcattgacgtttttgaagagtacaaaccagttttctgtagactctccctccgtttgagcttatctgacatttgctcgccgtgagatccaggccttgcatttgtactggaccctgttcttacacaccctgatccagcccacttgtgtagtctgggagtctgggacaacctccgtccgcccttctagccgggtcactgcaggcaagccttggtgctcttgcctgcgacgtggaaatgatgcctgcctgcagcgctgtatagtgcagagcgggcgaggggcatagggaagtcactggcacgtggtatgtgttggcagggctgcttctcaccccaaaccaagggagggacaggcagggaggctgagagcagcggcttgccctggagctgtcaggtgggaggcagagggcgggagaggctgtgggctgcccaggtctgatccctgacccacttgccacccgtgccctcagttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttttctctcctaagacacctgcaataaagtgtagcaccctggta

SEQ ID NO: 440015 - DNA, 234 bp, Homo sapiens
ccagctcgggggacaccacgtggtgaggctgaacattgctggtgctggggcttgggagtgggcccggcctttctctaacagtctccctccattttggcagtgccttgtgggacattgagactgggcagcagaagactgtatttgtgggacacacgggtgactgcatgagcctggctgtgtctcctgacttcaatctcttcatttcgggggcctgtgatgccagtgccaagctct

SEQ ID NO: 440016 - DNA, 1949 bp, Homo sapiens
ccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttttctctcctaagacacctgcaataaagtgtagcaccctggtaaaaaaaaaagaaaaacctcgtgccga

SEQ ID NO: 440017 - DNA, 1508 bp, Homo sapiens
  misc_feature (1327)..(1327): n is a, c, g, or t
  misc_feature (1329)..(1329): n is a, c, g, or t
ccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtggggctcncntctgggccggataaccggctgagcggctgggatcccgtgacggtgggtgggcccaggtccggggaggtccccatttggccgggcgtcggcaccgcggtgggcgcgctacctcggccgccgccgcttccggggtccctggggcccccacctgggcggcgcgcgcccgcgacgccgggcac

SEQ ID NO: 440018 - DNA, 2044 bp, Homo sapiens
ccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggtaagggccagccctggctgctgcttcctcagctggaaggaccctccccagccctccctccccattctgtaccccccatcagctcccatttcggactctcttactgctgtcccttgtcactgggtgactccacccctggaatccagtaccccttggttcccaactaggactgttttccctcagtgttgctctaagcagcctctctccactgcccaatgccatgactgctccctgccctaggagatctgtggaccatgactgtccagtcagttctgggttcctggcatttcaggggcacccactgagaggcaagacagcctcagggaaacatggaatcaaggcagaatcaaggagatctggagtggcccgagggccctgactgcagcctagggctcatctaagactagcctgaagttggtcagataggatggcttcttctctatcaagaggccaggtgctgatgaaaataacactggccaggggcagaatccaaatcctaattctgttgctcactttctgagtgtccttgcacaagtcactcctccatgggcctcagtttcttcatctggaagcaaagaaataggatgaacggttgccttctcttttccagcacctgtcaaggtgccctcgggttttttcatagtacacagatgcttccagcctttctctgtctgatcccagccctcccccaaccaaagctcttgacagagaaccccctgccct

SEQ ID NO: 440019 - DNA, 1758 bp, Homo sapiens
ccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttttctctcctaagacacctgcaataaagtgtagcaccctggta

SEQ ID NO: 440020 - DNA, 1060 bp, Homo sapiens
ccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgcttgtgggacattgagactggcagcagagactggattgggggacccccggtgaatgctgaccaggtgggttcctagttaaacctcatcggggccgatgccatgcagcttggaattgaaggacgccgtaatctggcccaaggcataacctggttccaga

SEQ ID NO: 440021 - DNA, 1234 bp, Homo sapiens
cctcggttccgttgcgtagcgtgtccctcagtgggacactgcagggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtttgattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctccgaaaacacagtgatcaccgaatgagggaaaaagcagacattcaacttcttgtttacactattgatgacttaattgataagctctcaactatagttaactagtatcacatgtttagttggtatgtaaactaatgtatccagaagattggaagagggataagaaatgaaagatcctgatactttaggtttttccctttcctctattttgtaaatataagatgagtattatttaatgatgtatttgcataagtaatgcaaattgtgaagaaggaccagctgctgtttagaaaattttctccttccttctgtccttgattttttttcattaaagtatttcctttttttaattc

SEQ ID NO: 440022 - DNA, 2332 bp, Homo sapiens
cctcggttccgttgcgtagcgtgtccctcagtgggacactgcagggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagattcttgttggatctagccttggagggtggcttatgcttcatgctgcaattgcacgaccagagaaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctccgaaaacacagtgatcaccgaatgagggaaaaagcagacattcaacttcttgtttacactattgatgacttaattgataagctctcaactatagttaactagtatcacatgtttagttggtatgtaaactaatgtatccagaagattggaagagggataagaaatgaaagatcctgatactttaggtttttccctttcctctattttgtaaatataagatgagtattatttaatgatgtatttgcataagtaatgcaaattgtgaagaaggaccagctgctgtttagaaaattttctccttccttctgtccttgattttttttcattaaagtatttcctttttttaattcaagaaaagtttacctttcttatgcttatgttagctatgccagctcttaattgcatccttttctaattaggattattaataaagcgtgaatattttgttttttattatagacagaaatttgtaacattacttctgatttgaaaatgcaattcacaaaatatagggaaatttttattgaagtaaatttgaaatgatggagaaatttcagaagcataataaagttcacaataaggataatactttatataatgtataaagtatatataatataatatatatgttatataaactgcacattatattcaaacttaaaattgagctttttttttaaaggcccaaaattgtacagtgatacaaggagctatttctaaaatttggcttatgtataatatatttaaatggggaatttcatctaaaacaatgatgtagtatttttaatattctgattggtaaaattaaagaggaaattaatctttatatattatttcttgcagaaacattcattattttattaatattgccctaagtacaactaggcaagtgattgccacctaaatcagaagacgttctaaagtcagtaagaaagtgtgaaatgctagtataaaggttattttttttctttcctaaataactaaagtgaggtgtagattgagccttgatattatttagttaatgttttttattaattaattttggctggactttatttagcttgattaggttattatctgtcaaaccttttaagttgacaacatgactcatatatatacatgtgtataagatgagcatgtgtcgaagacttattcgactcattaatgaggaaaccagcagatagtaaacctggttcaaagtacaattcaagaaactgagtatttatgggcattgaagaaaaaatgttgagataaaattgctgtgcagaaaaaagtgttaatgaagccgacctgactacttaaccttagagacctgctttacaaggttggcccttgattggcatctgggaacttggagttcagggggcttccaccattcccagaactgatcaaagtagcttactatatctaaactgtaaaacaatatagtttctcctgaacacctgctttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactggcggaggattcttggaagcttgcacttagtttcccctgacttcaccccatgtgtcttttttcctttgctgattttgttttgtatcctttcactgtaataaatcatggccgtgagcagaa

SEQ ID NO: 440023 - DNA, 2628 bp, Homo sapiens
cctcggttccgttgcgtagcgtgtccctcagtgggacactgcagggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtttgattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctccgaaaacacagtgatcaccgaatgagggaaaaagcagacattcaacttcttgtttacactattgatgacttaattgataagctctcaactatagttaactagtatcacatgtttagttggtatgtaaactaatgtatccagaagattggaagagggataagaaatgaaagatcctgatactttaggtttttccctttcctctattttgtaaatataagatgagtattatttaatgatgtatttgcataagtaatgcaaattgtgaagaaggaccagctgctgtttagaaaattttctccttccttctgtccttgattttttttcattaaagtatttcctttttttaattcaagaaaagtttacctttcttatgcttatgttagctatgccagctcttaattgcatccttttctaattaggattattaataaagcgtgaatattttgttttttattatagacagaaatttgtaacattacttctgatttgaaaatgcaattcacaaaatatagggaaatttttattgaagtaaatttgaaatgatggagaaatttcagaagcataataaagttcacaataaggataatactttatataatgtataaagtatatataatataatatatatgttatataaactgcacattatattcaaacttaaaattgagctttttttttaaaggcccaaaattgtacagtgatacaaggagctatttctaaaatttggcttatgtataatatatttaaatggggaatttcatctaaaacaatgatgtagtatttttaatattctgattggtaaaattaaagaggaaattaatctttatatattatttcttgcagaaacattcattattttattaatattgccctaagtacaactaggcaagtgattgccacctaaatcagaagacgttctaaagtcagtaagaaagtgtgaaatgctagtataaaggttattttttttctttcctaaataactaaagtgaggtgtagattgagccttgatattatttagttaatgttttttattaattaattttggctggactttatttagcttgattaggttattatctgtcaaaccttttaagttgacaacatgactcatatatatacatgtgtataagatgagcatgtgtcgaagacttattcgactcattaatgaggaaaccagcagatagtaaacctggttcaaagtacaattcaagaaactgagtatttatgggcattgaagaaaaaatgttgagataaaattgctgtgcagaaaaaagtgttaatgaagccgacctgactacttaaccttagagacctgctttacaaggttggcccttgattggcatctgggaacttggagttcagggggcttccaccattcccagaactgatcaaagtagcttactatatctaaactgtaaaacaatatagtttctcctgaacacctgctttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactggcggaggattcttggaagcttgcacttagtttcccctgacttcaccccatgtgtcttttttcctttgctgattttgttttgtatcctttcactgtaataaatcatggccgtgagcagaa

SEQ ID NO: 440024 - DNA, 2789 bp, Homo sapiens
cctcggttccgttgcgtagcgtgtccctcagtgggacactgcagggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtttgattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctccgaaaacacagtgatcaccgaatgagggaaaaagcagacattcaacttcttgtttacactattgatgacttaattgataagctctcaactatagttaactagtatcacatgtttagttggtatgtaaactaatgtatccagaagattggaagagggataagaaatgaaagatcctgatactttaggtttttccctttcctctattttgtaaatataagatgagtattatttaatgatgtatttgcataagtaatgcaaattgtgaagaaggaccagctgctgtttagaaaattttctccttccttctgtccttgattttttttcattaaagtatttcctttttttaattcaagaaaagtttacctttcttatgcttatgttagctatgccagctcttaattgcatccttttctaattaggattattaataaagcgtgaatattttgttttttattatagacagaaatttgtaacattacttctgatttgaaaatgcaattcacaaaatatagggaaatttttattgaagtaaatttgaaatgatggagaaatttcagaagcataataaagttcacaataaggataatactttatataatgtataaagtatatataatataatatatatgttatataaactgcacattatattcaaacttaaaattgagctttttttttaaaggcccaaaattgtacagtgatacaaggagctatttctaaaatttggcttatgtataatatatttaaatggggaatttcatctaaaacaatgatgtagtatttttaatattctgattggtaaaattaaagaggaaattaatctttatatattatttcttgcagaaacattcattattttattaatattgccctaagtacaactaggcaagtgattgccacctaaatcagaagacgttctaaagtcagtaagaaagtgtgaaatgctagtataaaggttattttttttctttcctaaataactaaagtgaggtgtagattgagccttgatattatttagttaatgttttttattaattaattttggctggactttatttagcttgattaggttattatctgtcaaaccttttaagttgacaacatgactcatatatatacatgtgtataagatgagcatgtgtcgaagacttattcgactcattaatgaggaaaccagcagatagtaaacctggttcaaagtacaattcaagaaactgagtatttatgggcattgaagaaaaaatgttgagataaaattgctgtgcagaaaaaagtgttaatgaagccgacctgactacttaaccttagagacctgctttacaaggttggcccttgattggcatctgggaacttggagttcagggggcttccaccattcccagaactgatcaaagtagcttactatatctaaactgtaaaacaatatagtttctcctgaacacctgctttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactggcggaggattcttggaagcttgcacttagtttcccctgacttcaccccatgtgtcttttttcctttgctgattttgttttgtatcctttcactgtaataaatcatggccgtgagcagaaatcggctataggagccggttcaatcactgggcgcgataaaggcgtgcgggaaacctgggtcccaatattcgctggggatcccctgcagagggaaaggcggcgaggcgccacaaggacgcgatggaagagagtgggcatagaacacggcagggtaccttcgg

SEQ ID NO: 440025 - DNA, 1116 bp, Homo sapiens
cctcggttccgttgcgtagcgtgtccctcagtgggacactgcagggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtttgattactcaggagttggaagttcagatggtaactcagaggaaagcacactggggaaatggagaaaagatgttctttctataattgatgacttagctgatgggccacagattcttgttggatctagccttggagggtggcttatgcttcatgctgcaattgcacgaccagagaaggtcgtggctcttattggtgtagctacagctgcagataccttagtgacaaagtttaatcagcttcctgttgagctaaaaaaggaagtagagatgaaaggtgtgtggagcatgccatcaaaatactctgaagaaggagtttataacgttcagtacagtttcattaaagaagctgaacatcactgcttgttacatagcccaattcctgtgaactgccccataagattgctccatggcatgaaggatgacattgtaccttggcatacatcaatgcaggttgccgatcgagtactcagcacagatgtggatgtcatcctccgaaaacacagtgatcaccgaatgagggaaaaagcagacattcaacttcttgtttacactattgatgacttaattgataagctctcaactatagttaactagtatcacatgtttagttggtatgtaaactaatgtatccagaagattggaagagggataagaaatgaaagatcctgatactttaggtttttccctttcctctattttgtaaatataagatgagtattattta

SEQ ID NO: 440026 - DNA, 1062 bp, Homo sapiens
gtagatgaagtacaaggaggttctgaggatcagcatcttcaaaaggatggtgcctcatactccatgcctaggggtaatagatggtgcacattaatgctttaaagcacagctccgccctgcaccatactggcatatgagttgactgcagccacccctcaaacttttcatgccctaccacagctagtcaaaggaaaatgcccgaacttttctaaacagccctggactcttttttcccttctctgtgctgaggagttgaggactatccccatttaaaactgcagctgttcccctctttaccctcttcacacagtggagctggccaagggcaggcacagcctcaccactgggaagtctgaagagccaccgggttgccctgatagcaccatgctctaacagattggtgggctggatgaaaatgcttccagggttcacagcgcatcacgtaccaccttccaaagacaaaagctgaaggtcagtagagtggagctagagagggggtgcttgctgcaaagggactgctttacccataatttcaccttccaagaagaacagggacaggaccaacaggcaagccaggcaacaacagagaatacccccgccctgagtttgtgcctctcaggttccagcctgtgtagtgactgccgatcgctccgactaaacaggaaggggaacccctttcggagccctggtgggaaagacattgttttaaccagttcataatcagccattagagaagaaagcagcatctgcgatgtcagcacaggctgatggtcactggtacactacggaattttataaacctggtggttcgtgtgccttggtcaccgctggctgcaaatgaagataattttcccaaaaggagcattcagttgcattctcattttcccttttggctctttcaaatataaacaagtacaataatgtttaacactggggaaatatacagtaagttacagactgtgctgtggccctgagggccggagctggttaaagggacaggacgccctgcccgcagttctgccctctggccctgagcttttatgaagcctattttcctaataa

SEQ ID NO: 440027 - DNA, 1894 bp, Homo sapiens
acagcggcggccgcatcgcgcctgcgcagtgccctcgtcccccgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggccgcagccctggctgactgcacggcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 440028 - DNA, 1927 bp, Homo sapiens
acagcggcggccgcatcgcgcctgcgcagtgccctcgtcccccgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggccgcagccctggctgactgcacggcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagtacatgccatgtgtccctcaactgaaaaaaaaaaa

SEQ ID NO: 440029 - DNA, 303 bp, Homo sapiens
gagagagagagagagagagagagagagagagagaggagagagagagagagagagagagagagaggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 440030 - DNA, 354 bp, Homo sapiens
ctgttctgcctgggcctgccccactcgcccgcctgcttgctttgcactagaagcagcccgctctgtctagggaggtgcagtcgctagtgagcaagtcgccacggcatgctggctgcgctggggaggagctggggtccctgatttggccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 440031 - DNA, 755 bp, Homo sapiens
gtgttgctttacggtctcaaggtggctcttaactctcagggaggctgagaaagcaggcattttgtgttactggcctctctattggagacagctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaagtaggtgcctgcgctctggggggccctgaggagcagtgtgaccctggggaagaagaggacccaccagcccaggcaactggggctgctggggtcattccggtgctcgtgcctccctccacctcccgactctccagagggaattttccccctgctcaaggcacaatggaaaagcccacaacacttgccatgccatcatgacaacattcctttcccttcctcctctctggaccctgcccaccccaacactgagctctgtgcaccgctcctgtgaagttccacctctctctgtctctgtagggcccaagaaagtgtctctgctcactctactgcctcggtggctgcagacccccagcccacacgcaggcagtagagccaagggacgcctcccca

SEQ ID NO: 440032 - DNA, 1918 bp, Homo sapiens
caagcccagaataacctggatgtgtgactcacaggggtaggggtagcaattttgcagattttccaaacaggtgacttcagcccccgggcctgggcaggaaggggtagcccagtgacaatgggcatagtcccacttcaggaacgggaaacgtgttggctggctctgtggagttctctctcttctgatcccacagcatctgttccagttgtcttggccgctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggccgcagccctggctgactgcacggcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 440033 - DNA, 1877 bp, Homo sapiens
ctgttctgcctgggcctgccccactcgcccgcctgcttgctttgcactagaagcagcccgctctgtctagggaggtgcagtcgctagtgagcaagtcgccacggcatgctggctgcgctggggaggagctggggtccctgatttggccaccactgtgcagatacctggtccagcccagcagagggcaaaagagcccatcctgacacagggcccctggaggggcagccacccagggacaatggctttgggctggggcttctgttaggaaagaccctgtgccagctgcctttcctctagctatgagtacgagagggtcccgcacccttccaactctacttccccaaatttgcgtcctaatttctctcctctatccctcaggccagctctctccctgccccaacacctcacaccttgtttagttccctatagtttctgctctcccgggctcgccaaagggctgcccagctgctggagtgtccatgtggccaagactcggggcctagctgtagatgcccttcctggggtgggggcaggggggtgagagtgcctgcctgtcgcatgggcctgcccccgcagtcctcacaccaggctgtctcctgccacgtgcgctgtgggctcacgtggacttacctgactcttttcctctgggcagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggccgcagccctggctgactgcacggcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 440034 - DNA, 1811 bp, Homo sapiens
acagcggcggccgcatcgcgcctgcgcagtgccctcgtcccccgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccagttccacagaggacgtcccccacaggccccccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggccgcagccctggctgactgcacggcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 440035 - DNA, 828 bp, Homo sapiens
acagcggcggccgcatcgcgcctgcgcagtgccctcgtcccccgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcagcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 440036 - DNA, 857 bp, Homo sapiens
acagcggcggccgcatcgcgcctgcgcagtgccctcgtcccccgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaagtaggtgcctgcgctctggggggccctgaggagcagtgtgaccctggggaagaagaggacccaccagcccaggcaactggggctgctggggtcattccggtgctcgtgcctccctccacctcccgactctccagagggaattttccccctgctcaaggcacaatggaaaagcccacaacacttgccatgccatcatgacaacattcctttcccttcctcctctctggaccctgcccaccccaacactgagctctgtgcaccgctcctgtgaagttccacctctctctgtctctgtagggcccaagaaagtgtctctgctcactctactgcctcggtggctgcagacccccagcccacacgcaggcagtagagccaagggacgcctcccca

SEQ ID NO: 440037 - DNA, 1849 bp, Homo sapiens
acagcggcggccgcatcgcgcctgcgcagtgccctcgtcccccgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggccgcagccctggctgactgcacggcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 440038 - DNA, 1677 bp, Homo sapiens
acagcggcggccgcatcgcgcctgcgcagtgccctcgtcccccgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggaaggattcgcaccccctgaggacgatgagattgaagagcatcaacaagaagaccaggacgagtactgagggcggccgcagccctggctgactgcacggcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggacccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 440039 - DNA, 894 bp, Homo sapiens
acagcggcggccgcatcgcgcctgcgcagtgccctcgtcccccgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactctggggtatggccgtcaatgtgtactccacatctgtgaccagtgaaaatctgagtcgccatgatatgcttgcatgggtcaacgactccctgcacctcaactataccaagatagaacagctttgttcaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaaatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcagttccacagaggacgtcccccacaggcccaaaaaacatgcagacctctggccggctgagcaatgtggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagta

SEQ ID NO: 440040 - DNA, 5457 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440041 - DNA, 5407 bp, Homo sapiens
gaccagatcagcccccagagcagcctcatggctggaggatccaagagaggttagatccgtctgtctgtctgctaccttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440042 - DNA, 508 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccaggggcatattaaaggcttttggcagcaaagtgtca

SEQ ID NO: 440043 - DNA, 5570 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgaggccccatgggagcctgagcatacaggagttgggggagccagggcccagtgaggggtggggaggctaaccgggccaggactctggccatcctcgttttcctgccctcaggtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440044 - DNA, 4804 bp, Homo sapiens
tctagaggatcaccgtcagtaaggggtgccagtgatgacgttggtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440045 - DNA, 2543 bp, Homo sapiens
  misc_feature (218)..(218): n is a, c, g, or t
  misc_feature (408)..(408): n is a, c, g, or t
tacccccgtagtcccaatacgagggcaaaagcagagatggcagtaccagtctcggctctgctcaaccgtcagggcagcttccaagggggattccgcagtacccaagacacggtgattgccctggatgcctgtctgcctactggattgcctcccacaccactgaggagaggggtctcaatgtgactctcagctccacaggccggaatgggttcaagtcncacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaangccacgtcgagtacacgatggaagcaaacgaggactatgaggactatgagtacgatgagcttccagccaaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440046 - DNA, 5405 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcgcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440047 - DNA, 4086 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggagccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440048 - DNA, 5776 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttgtggcccgcttggcccaagtcaattttaaactgaacaaacttaatccttgcgcccgaatttggacctaattggccaaattccccttaaagggagccgtttaaaaatcaatggcccgtgttttaaaaacgtggaaatgggaaaaacctgggggtacccaaattaaatcccttggaagaaaatccccttttcccgttggcttaccagccccccccct

SEQ ID NO: 440049 - DNA, 1055 bp, Homo sapiens
cgggagctgccctgggccaggggagggagggcaggacccaggctggggctgggcttctggagcccgcgcaggcagaacctggacgacagctcacacgtctccacaggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440050 - DNA, 5639 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggctgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440051 - DNA, 5720 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctcgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440052 - DNA, 5137 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaagttaaggttctccgagcacagaactgttttcgcctttttgagaccaagatcaccaaattcttgacttcaccaaagatgtgagggcggttgtaataaatgcgcaccttctgggttgagcctctggcgcctctttgggccgggcgttggactgattactggtcgg

SEQ ID NO: 440053 - DNA, 822 bp, Homo sapiens
ggtgacgtccgcgatggccatgccagacaagccccaccttgccgtccggcagatgcacacggtgtagtgaccctggactcctgctcctccaccaccttgggcgcctccctcctgcggcggttcctccgaccctcaaacagctgcaggggtgtcacgggctggagagggggatctggtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440054 - DNA, 923 bp, Homo sapiens
tccctgggactgaggaggcagaatggaggggcctgtgccctaactcctctctgttctccagagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggctgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440055 - DNA, 4145 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagtaggggccgtccccgggtgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440056 - DNA, 1226 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccagctggtgatatgtataaggcagagctcacatctaggtaagtagtgtcctctagcaatcaagttatagtttatcgcagagtcctcaaaagggg

SEQ ID NO: 440057 - DNA, 522 bp, Homo sapiens
gactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggctgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcagtatgaagcaaaccggagaggcgg

SEQ ID NO: 440058 - DNA, 838 bp, Homo sapiens
gggctgcagggcccagggagtgggtccctcatctctcctccccacgcttggccaggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440059 - DNA, 5254 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440060 - DNA, 4625 bp, Homo sapiens
tatcccccatgtcagcttcgctcaggccatctagtatgaaatgcagttagtacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440061 - DNA, 5405 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctctcctccccacgcttggccaggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 440062 - DNA, 5964 bp, Homo sapiens
  misc_feature (5852)..(5852): n is a, c, g, or t
  misc_feature (5915)..(5915): n is a, c, g, or t
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcaaaaaaaaaaaaaaaaaaaaaactcgagctcgtgccgaattcggcacgagggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgcttggggttctgtggccttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcaccccttccttgnctcatagatgctccttttgaccttttcaaataaatatggatggcaagctcctaaaccaaatanaaacccccaaaacaacacacccacccgaccctatacaaaaatacatgcg

SEQ ID NO: 440063 - DNA, 4861 bp, Homo sapiens
aggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca
